United States Patent 11,241,493 (CORONAVIRUS VACCINE) - sequence listing, part 8

SEQ ID NO: 11597 - protein, 1301 aa, Artificial Sequence
  SARS-CoV-2/Wuhan/WIV05/2019__EPI_ISL_402128 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11598 - protein, 1297 aa, Artificial Sequence
  SARS-CoV-2/bat/Yunnan/RaTG13/2013__EPI_ISL_402131 spike protein (1-1143)(T870C_S1051C) WhcAg construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11599 - protein, 1301 aa, Artificial Sequence
  SARS-CoV-2/Wuhan/HBCDC-HB-01/2019__EPI_ISL_402132 spike protein (1-1147)(T874C_S1055C) WhcAg construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11600 - protein, 1301 aa, Artificial Sequence
  SARS-CoV-2/Guangdong/20SF028/2020__EPI_ISL_403936 spike protein (1-1147)(T874C_S1055C) WhcAg construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11601 - protein, 1301 aa, Artificial Sequence
  SARS-CoV-2/Shenzhen/SZTH-001/2020__EPI_ISL_406592 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVLIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11602 - protein, 1301 aa, Artificial Sequence
  SARS-CoV-2/Shenzhen/SZTH-004/2020__EPI_ISL_406595 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11603 - protein, 1301 aa, Artificial Sequence
  SARS-CoV-2/France/IDF0372/2020__EPI_ISL_406596 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11604 - protein, 1301 aa, Artificial Sequence
  SARS-CoV-2/Australia/VIC01/2020__EPI_ISL_406844 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11605 - protein, 1301 aa, Artificial Sequence
  SARS-CoV-2/Germany/BavPat1/2020__EPI_ISL_406862 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11606 - protein, 1301 aa, Artificial Sequence
  SARS-CoV-2/Wuhan/HBCDC-HB-02/2020__EPI_ISL_412978 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11607 - protein, 1301 aa, Artificial Sequence
  SARS-CoV-2/Australia/QLD02/2020__EPI_ISL_407896 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQLELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11608 - protein, 1301 aa, Artificial Sequence
  SARS-CoV-2/India/1-31/2020__EPI_ISL_413523 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11609 - protein, 1301 aa, Artificial Sequence
  SARS-CoV-2/Guangdong/GD2020087-P0008/2020__EPI_ISL_413863 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11610 - protein, 1301 aa, Artificial Sequence
  SARS-CoV-2/Sweden/01/2020__EPI_ISL_411951 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11611 - protein, 1301 aa, Artificial Sequence
  SARS-CoV-2/Tianmen/HBCDC-HB-07/2020__EPI_ISL_412983 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11612 - protein, 1301 aa, Artificial Sequence
  SARS-CoV-2/Hong Kong/case42_VM20002493/2020__EPI_ISL_414527 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11613 - protein, 1301 aa, Artificial Sequence
  SARS-CoV-2/USA/CruiseA-23/2020__EPI_ISL_414482 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11614 - protein, 1301 aa, Artificial Sequence
  SARS-CoV-2/Hong Kong/case85_VM20002868/2020__EPI_ISL_414519 spike protein (1-1147)(T874C_S1055C) WhcAg construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11615 - protein, 1301 aa, Artificial Sequence; identical to SEQ ID NO: 11605
  SARS-CoV-2/England/200990660/2020__EPI_ISL_414523 spike protein (1-1147)(T874C_S1055C) WhcAg construct

SEQ ID NO: 11616 - protein, 1301 aa, Artificial Sequence
  SARS-CoV-2/Australia/NSW09/2020__EPI_ISL_413595 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11617 - protein, 1301 aa, Artificial Sequence; identical to SEQ ID NO: 11597
  SARS-CoV-2/Australia/NSW10/2020__EPI_ISL_413596 spike protein (1-1147)(T874C_S1055C) WhcAg construct

SEQ ID NO: 11618 - protein, 1301 aa, Artificial Sequence
  SARS-CoV-2/Switzerland/1000477797/2020__EPI_ISL_413023 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11619 - protein, 1301 aa, Artificial Sequence
  SARS-CoV-2/Belgium/BA-02291/2020__EPI_ISL_415159 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11620 - protein, 1301 aa, Artificial Sequence
  SARS-CoV-2/USA/WA8-UW5/2020__EPI_ISL_413486 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11621 - protein, 1301 aa, Artificial Sequence
  SARS-CoV-2/England/20102000506/2020__EPI_ISL_415147 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11622 - protein, 1301 aa, Artificial Sequence
  SARS-CoV-2/Belgium/VAG-03013/2020__EPI_ISL_415155 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11623 - protein, 1301 aa, Artificial Sequence
  SARS-CoV-2/Belgium/BC-03016/2020__EPI_ISL_415157 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11624 - protein, 1301 aa, Artificial Sequence
  SARS-CoV-2/Germany/BavPat3/2020__EPI_ISL_414521 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11625 - protein, 1301 aa, Artificial Sequence
  SARS-CoV-2/France/HF1805/2020__EPI_ISL_414628 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGVVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11626 - protein, 1301 aa, Artificial Sequence
  SARS-CoV-2/Netherlands/ZuidHolland_9/2020__EPI_ISL_414445 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11627 - protein, 1301 aa, Artificial Sequence
  SARS-CoV-2/Finland/FIN03032020A/2020__EPI_ISL_413602 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11628 - protein, 1301 aa, Artificial Sequence
  SARS-CoV-2/France/GE1977/2020__EPI_ISL_414632 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11629 - protein, 1301 aa, Artificial Sequence
  SARS-CoV-2/Finland/FIN-313/2020__EPI_ISL_414641 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11630 - protein, 1301 aa, Artificial Sequence
  SARS-CoV-2/Netherlands/ZuidHolland_2/2020__EPI_ISL_414556 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11631 - protein, 1301 aa, Artificial Sequence
  SARS-CoV-2/USA/WA-UW31/2020__EPI_ISL_414618 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11632 - protein, 1301 aa, Artificial Sequence
  SARS-CoV-2/South Korea/SNU01/2020__EPI_ISL_411929 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11633 - protein, 1301 aa, Artificial Sequence
  SARS-CoV-2/China/WF0004/2020__EPI_ISL_413694 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11634 - protein, 1301 aa, Artificial Sequence
  SARS-CoV-2/China/WF0028/2020__EPI_ISL_413791 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELESGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11635 - protein, 1301 aa, Artificial Sequence
  SARS-CoV-2/2019-nCoV/USA-CruiseA-18/2020__MT159716.1 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11636 - protein, 1301 aa, Artificial Sequence
  SARS-CoV-2/SARS-CoV-2/Yunnan-01/human/2020/CHN__MT049951.1 spike protein (1-1147)(T874C_S1055C) WhcAg construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11637 - protein, 1301 aa, Artificial Sequence
  SARS-CoV-2/USA/WA-UW292/2020__EPI_ISL_418077 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11638 - protein, 1301 aa, Artificial Sequence
  SARS-CoV-2/Iceland/192/2020__EPI_ISL_417819 spike protein (1-1147)(T874C_S1055C) WhcAg construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11639 - protein, 1301 aa, Artificial Sequence
  SARS-CoV-2/Belgium/ULG-6939/2020__EPI_ISL_417020 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11640 - protein, 1301 aa, Artificial Sequence
  SARS-CoV-2/France/HF2496/2020__EPI_ISL_418231 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11641 - protein, 1301 aa, Artificial Sequence
  SARS-CoV-2/USA/WA-UW291/2020__EPI_ISL_418076 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11642 - protein, 1301 aa, Artificial Sequence; identical to SEQ ID NO: 11605
  SARS-CoV-2/Portugal/PT0034/2020__EPI_ISL_418019 spike protein (1-1147)(T874C_S1055C) WhcAg construct

SEQ ID NO: 11643 - protein, 1301 aa, Artificial Sequence; identical to SEQ ID NO: 11597
  SARS-CoV-2/Iceland/202/2020__EPI_ISL_417750 spike protein (1-1147)(T874C_S1055C) WhcAg construct

SEQ ID NO: 11644 - protein, 1301 aa, Artificial Sequence
  SARS-CoV-2/USA/WA-UW261/2020__EPI_ISL_418046 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11645 - protein, 1301 aa, Artificial Sequence
  SARS-CoV-2/Portugal/PT0035/2020__EPI_ISL_418020 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11646 - protein, 1301 aa, Artificial Sequence
  SARS-CoV-2/USA/NY-NYUMC7/2020__EPI_ISL_418192 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11647 - protein, 1301 aa, Artificial Sequence
  SARS-CoV-2/Iceland/189/2020__EPI_ISL_417709 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11648 - protein, 1301 aa, Artificial Sequence
  SARS-CoV-2/Australia/NSW56/2020__EPI_ISL_417408 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11649 - protein, 1301 aa, Artificial Sequence
  SARS-CoV-2/Iceland/280/2020__EPI_ISL_417608 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11650 - protein, 1301 aa, Artificial Sequence; identical to SEQ ID NO: 11605
  SARS-CoV-2/Iceland/247/2020__EPI_ISL_417575 spike protein (1-1147)(T874C_S1055C) WhcAg construct

SEQ ID NO: 11651 - protein, 1301 aa, Artificial Sequence
  SARS-CoV-2/Iceland/238/2020__EPI_ISL_417566 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11652 - protein, 1301 aa, Artificial Sequence
  SARS-CoV-2/Greece/16/2020__EPI_ISL_418265 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11653 - protein, 1301 aa, Artificial Sequence
  SARS-CoV-2/Iceland/319/2020__EPI_ISL_417648 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11654 - protein, 1301 aa, Artificial Sequence
  SARS-CoV-2/Congo/94/2020__EPI_ISL_417947 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11655 - protein, 1301 aa, Artificial Sequence
  SARS-CoV-2/Congo/158/2020__EPI_ISL_417950 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFLSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11656 - protein, 1301 aa, Artificial Sequence
  SARS-CoV-2/USA/UT-00034/2020__EPI_ISL_417977 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11657 - protein, 1301 aa, Artificial Sequence
  SARS-CoV-2/USA/UT-00033/2020__EPI_ISL_417976 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11658 - protein, 1301 aa, Artificial Sequence
  SARS-CoV-2/USA/WI-13/2020__EPI_ISL_417516 spike protein (1-1147)(T874C_S1055C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11659 - protein, 1300 aa, Artificial Sequence
  SARS-CoV-2/India/1-27/2020__EPI_ISL_413522 spike protein (1-1146)(T873C_S1054C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHDGKAHFPREGVFVSNGTHWFVTQRNFYEPQIITTDNTFVSGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11660 - protein, 1295 aa, Artificial Sequence
  SARS-CoV-2/pangolin/Guangxi/P4L/2017__EPI_ISL_410538 spike protein (1-1141)(T868C_S1049C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11661 - protein, 1295 aa, Artificial Sequence
  SARS-CoV-2/pangolin/Guangxi/P5L/2017__EPI_ISL_410540 spike protein (1-1141)(T868C_S1049C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11662 - protein, 1295 aa, Artificial Sequence
  SARS-CoV-2/pangolin/Guangxi/P5E/2017__EPI_ISL_410541 spike protein (1-1141)(T868C_S1049C) WhcAg construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11663 - protein, 1293 aa, Artificial Sequence
  SARS-CoV-2/pangolin/Guangxi/P1E/2017__EPI_ISL_410539 spike protein (1-1139)(T866C_S1047C) WhcAg construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYCSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQCAPHGVVFLHVTYVPAQEKNFTTAPAICHEGKAHFPREGVFVSNGTHWFITQRNFYEPQIITTDNTFVSGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 11664 - RNA, 3822 nt, Artificial Sequence; identical to SEQ ID NO: 116
  SARS-CoV-2/Wuhan/WIV05/2019__EPI_ISL_402128 spike protein CDS wt (1-1273)

SEQ ID NO: 11665 - RNA, 3810 nt, Artificial Sequence; identical to SEQ ID NO: 118
  SARS-CoV-2/bat/Yunnan/RaTG13/2013__EPI_ISL_402131 spike protein CDS wt (1-1269)

SEQ ID NO: 11666 - RNA, 3822 nt, Artificial Sequence; identical to SEQ ID NO: 119
  SARS-CoV-2/Wuhan/HBCDC-HB-01/2019__EPI_ISL_402132 spike protein CDS wt (1-1273)

SEQ ID NO: 11667 - RNA, 3822 nt, Artificial Sequence; identical to SEQ ID NO: 121
  SARS-CoV-2/Guangdong/20SF028/2020__EPI_ISL_403936 spike protein CDS wt (1-1273)

SEQ ID NO: 11668 - RNA, 3822 nt, Artificial Sequence; identical to SEQ ID NO: 126
  SARS-CoV-2/Shenzhen/SZTH-001/2020__EPI_ISL_406592 spike protein CDS wt (1-1273)

SEQ ID NO: 11669 - RNA, 3822 nt, Artificial Sequence; identical to SEQ ID NO: 127
  SARS-CoV-2/Shenzhen/SZTH-004/2020__EPI_ISL_406595 spike protein CDS wt (1-1273)

SEQ ID NO: 11670 - RNA, 3822 nt, Artificial Sequence; identical to SEQ ID NO: 128
  SARS-CoV-2/France/IDF0372/2020__EPI_ISL_406596 spike protein CDS wt (1-1273)

SEQ ID NO: 11671 - RNA, 3822 nt, Artificial Sequence; identical to SEQ ID NO: 130
  SARS-CoV-2/Australia/VIC01/2020__EPI_ISL_406844 spike protein CDS wt (1-1273)

SEQ ID NO: 11672 - RNA, 3822 nt, Artificial Sequence; identical to SEQ ID NO: 131
  SARS-CoV-2/Germany/BavPat1/2020__EPI_ISL_406862 spike protein CDS wt (1-1273)

SEQ ID NO: 11673 - RNA, 3822 nt, Artificial Sequence
  SARS-CoV-2/Wuhan/HBCDC-HB-02/2020__EPI_ISL_412978 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaauuuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11674 - RNA, 3822 nt, Artificial Sequence
  SARS-CoV-2/Australia/QLD02/2020__EPI_ISL_407896 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaacuugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11675 - RNA, 3822 nt, Artificial Sequence
  SARS-CoV-2/India/1-31/2020__EPI_ISL_413523 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauaguguuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11676 - RNA, 3822 nt, Artificial Sequence
  SARS-CoV-2/Guangdong/GD2020087-P0008/2020__EPI_ISL_413863 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagagaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11677 - RNA, 3822 nt, Artificial Sequence
  SARS-CoV-2/Sweden/01/2020__EPI_ISL_411951 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuguggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11678 - RNA, 3822 nt, Artificial Sequence
  SARS-CoV-2/Tianmen/HBCDC-HB-07/2020__EPI_ISL_412983 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggaucuuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11679 - RNA, 3822 nt, Artificial Sequence
  SARS-CoV-2/Hong Kong/case42_VM20002493/2020__EPI_ISL_414527 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuugcuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11680 - RNA, 3822 nt, Artificial Sequence
  SARS-CoV-2/USA/CruiseA-23/2020__EPI_ISL_414482 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaguaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11681 - RNA, 3822 nt, Artificial Sequence
  SARS-CoV-2/Hong Kong/case85_VM20002868/2020__EPI_ISL_414519 spike protein CDS wt (1-1273)
auguuuguuuuucuuguuuuagugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11682 - RNA, 3822 nt, Artificial Sequence
  SARS-CoV-2/England/200990660/2020__EPI_ISL_414523 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagcuagugcucaaaggagucaaauuacauuacacauaa

SEQ ID NO: 11683 - RNA, 3822 nt, Artificial Sequence
  SARS-CoV-2/Australia/NSW09/2020__EPI_ISL_413595 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuucacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11684 - RNA, 3822 nt, Artificial Sequence
  SARS-CoV-2/Australia/NSW10/2020__EPI_ISL_413596 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcuucaaauuugaugaagacgacucugagccagugcucaaaggagucaaauuacauuacacauaa

SEQ ID NO: 11685 - RNA, 3822 nt, Artificial Sequence
  SARS-CoV-2/Switzerland/1000477797/2020__EPI_ISL_413023 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaacauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11686 - RNA, 3822 nt, Artificial Sequence
  SARS-CoV-2/Belgium/BA-02291/2020__EPI_ISL_415159 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaggucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuaccugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuucugcagcaccugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11687 - RNA, 3822 nt, Artificial Sequence
  SARS-CoV-2/USA/WA8-UW5/2020__EPI_ISL_413486 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaauaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11688 - RNA, 3822 nt, Artificial Sequence
  SARS-CoV-2/England/20102000506/2020__EPI_ISL_415147 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauaugguuauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11689 - RNA, 3822 nt, Artificial Sequence
  SARS-CoV-2/Belgium/VAG-03013/2020__EPI_ISL_415155 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaacugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11690 - RNA, 3822 nt, Artificial Sequence
  SARS-CoV-2/Belgium/BC-03016/2020__EPI_ISL_415157 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaccugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11691 - RNA, 3822 nt, Artificial Sequence
  SARS-CoV-2/Germany/BavPat3/2020__EPI_ISL_414521 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaacaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11692 - RNA, 3822 nt, Artificial Sequence
  SARS-CoV-2/France/HF1805/2020__EPI_ISL_414628 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaguugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11693 - RNA, 3822 nt, Artificial Sequence
  SARS-CoV-2/Netherlands/ZuidHolland_9/2020__EPI_ISL_414445 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuuguguacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11694 - RNA, 3822 nt, Artificial Sequence
  SARS-CoV-2/Finland/FIN03032020A/2020__EPI_ISL_413602 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauaucuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11695 - RNA, 3822 nt, Artificial Sequence
  SARS-CoV-2/France/GE1977/2020__EPI_ISL_414632 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuuuuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11696 - RNA, 3822 nt, Artificial Sequence
  SARS-CoV-2/Finland/FIN-313/2020__EPI_ISL_414641 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuuaaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaaucuaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11697 - RNA, 3822 nt, Artificial Sequence
  SARS-CoV-2/Netherlands/ZuidHolland_2/2020__EPI_ISL_414556 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcucuugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11698 - RNA, 3822 nt, Artificial Sequence
  SARS-CoV-2/USA/WA-UW31/2020__EPI_ISL_414618 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaauggugcugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11699 - RNA, 3822 nt, Artificial Sequence
  SARS-CoV-2/South Korea/SNU01/2020__EPI_ISL_411929 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuugggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11700 - RNA, 3822 nt, Artificial Sequence
  SARS-CoV-2/China/WF0004/2020__EPI_ISL_413694 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggacggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagauuugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11701 - RNA, 3822 nt, Artificial Sequence
  SARS-CoV-2/China/WF0028/2020__EPI_ISL_413791 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagaaucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11702 - RNA, 3822 nt, Artificial Sequence
  SARS-CoV-2/2019-nCoV/USA-CruiseA-18/2020__MT159716.1 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguuaagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11703 - RNA, 3822 nt, Artificial Sequence
  SARS-CoV-2/SARS-CoV-2/Yunnan-01/human/2020/CHN__MT049951.1 spike protein CDS wt (1-1273)
auguuuguuuuucuuguuuuauugccacuagucucuagucaguguguuaaucuuacaaccagaacucaauuacccccugcaaacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11704 - RNA, 3822 nt, Artificial Sequence
  SARS-CoV-2/USA/WA-UW292/2020__EPI_ISL_418077 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccaguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11705 - RNA, 3822 nt, Artificial Sequence
  SARS-CoV-2/Iceland/192/2020__EPI_ISL_417819 spike protein CDS wt (1-1273)
auguuuguuuuuuuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11706 - RNA, 3822 nt, Artificial Sequence
  SARS-CoV-2/Belgium/ULG-6939/2020__EPI_ISL_417020 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguuguuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11707 - RNA, 3822 nt, Artificial Sequence
  SARS-CoV-2/France/HF2496/2020__EPI_ISL_418231 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauuguugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11708 - RNA, 3822 nt, Artificial Sequence
  SARS-CoV-2/USA/WA-UW291/2020__EPI_ISL_418076 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaauacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11709 - RNA, 3822 nt, Artificial Sequence
  SARS-CoV-2/Portugal/PT0034/2020__EPI_ISL_418019 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguauuaccaguugcuguaguugucucaagggcuguuguucuuguggauccugcugcaaauuugaugaagacgacucugagccagugcucaaaggagucaaauuacauuacacauaa

SEQ ID NO: 11710 - RNA, 3822 nt, Artificial Sequence
  SARS-CoV-2/Iceland/202/2020__EPI_ISL_417750 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucccuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11711 - RNA, 3822 nt, Artificial Sequence
  SARS-CoV-2/USA/WA-UW261/2020__EPI_ISL_418046 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuuacaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11712 - RNA, 3822 nt, Artificial Sequence
  SARS-CoV-2/Portugal/PT0035/2020__EPI_ISL_418020 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauuucugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11713 - RNA, 3822 nt, Artificial Sequence
  SARS-CoV-2/USA/NY-NYUMC7/2020__EPI_ISL_418192 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuaucaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11714 - RNA, 3822 nt, Artificial Sequence
  SARS-CoV-2/Iceland/189/2020__EPI_ISL_417709 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaccaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11715 - RNA, 3822 nt, Artificial Sequence
  SARS-CoV-2/Australia/NSW56/2020__EPI_ISL_417408 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauucaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11716 - RNA, 3822 nt, Artificial Sequence
  SARS-CoV-2/Iceland/280/2020__EPI_ISL_417608 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucauacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11717 - RNA, 3822 nt, Artificial Sequence
  SARS-CoV-2/Iceland/247/2020__EPI_ISL_417575 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauugugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11718 - RNA, 3822 nt, Artificial Sequence
  SARS-CoV-2/Iceland/238/2020__EPI_ISL_417566 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagauguuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11719 - RNA, 3822 nt, Artificial Sequence
  SARS-CoV-2/Greece/16/2020__EPI_ISL_418265 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauguugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11720 - RNA, 3822 nt, Artificial Sequence
  SARS-CoV-2/Iceland/319/2020__EPI_ISL_417648 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauagaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11721 - RNA, 3822 nt, Artificial Sequence
  SARS-CoV-2/Congo/94/2020__EPI_ISL_417947 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagauauacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11722 - RNA, 3822 nt, Artificial Sequence
  SARS-CoV-2/Congo/158/2020__EPI_ISL_417950 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuuuugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11723 - RNA, 3822 nt, Artificial Sequence
  SARS-CoV-2/USA/UT-00034/2020__EPI_ISL_417977 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuacuacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11724 - RNA, 3822 nt, Artificial Sequence
  SARS-CoV-2/USA/UT-00033/2020__EPI_ISL_417976 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuugacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11725 - RNA, 3822 nt, Artificial Sequence
  SARS-CoV-2/USA/WI-13/2020__EPI_ISL_417516 spike protein CDS wt (1-1273)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccuaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11726 - RNA, 3819 nt, Artificial Sequence
  SARS-CoV-2/India/1-27/2020__EPI_ISL_413522 spike protein CDS wt (1-1272)
auguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucauacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaa

SEQ ID NO: 11727 - RNA, 3804 nt, Artificial Sequence
  SARS-CoV-2/pangolin/Guangxi/P4L/2017__EPI_ISL_410538 spike protein CDS wt (1-1267)
auguuuguuuuucuuuuugucuugccuuugguuuccagucaaugugucaauuugaccacaagaacuggaauaccgccagguuauaccaauucaucuacuagaggugucuauuauccagacaaaguuuuuaggucuucaauuuuacaucuuacacaagaccuuuucuuaccuuucuuuucuaauguuacuugguuuaacaccauaaauuaucaaggaggcuuuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaaucuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugguaauuaugguuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauugcguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacccauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaa

SEQ ID NO: 11728 - RNA, 3804 nt, Artificial Sequence
  SARS-CoV-2/pangolin/Guangxi/P5L/2017__EPI_ISL_410540 spike protein CDS wt (1-1267)
auguuuguuuuucuuuuugucuugccuuugguuuccagucaaugugucaauuugaccacaagaacuggaauaccgccagguuauaccaauucaucuacuagaggugucuauuauccagacaaaguuuuuaggucuucaauuuuacaucuuacacaagaccuuuucuuaccuuucuuuucuaauguuacuugguuuaacaccauaaauuaucaaggaggcuuuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaagcuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugguaauuaugguuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauuucguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacucauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaa

SEQ ID NO: 11729 - RNA, 3804 nt, Artificial Sequence
  SARS-CoV-2/pangolin/Guangxi/P5E/2017__EPI_ISL_410541 spike protein CDS wt (1-1267)
auguuuguuuuucuuuuugucuugccuuugguuuccagucaaugugucaauuugaccacaagaacuggaauaccgccagguuauaccaauucaucuacuagaggugucuauuauccagacaaaguuuuuaggucuucaauuuuacaucuuacacaagaccuuuucuuaccuuucuuuucuaauguuacuugguuuaacaccauaacuuaucaaggaggcucuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaagcuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugauaauuaugguuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauuucguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacucauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaa

SEQ ID NO: 11730 - RNA, 3798 nt, Artificial Sequence
  SARS-CoV-2/pangolin/Guangxi/P1E/2017__EPI_ISL_410539 spike protein CDS wt (1-1265)
auguuuguuuuucuuuuugucuugccuuugguuuccagucaaugugucaauuugaccacaagaacuggaauacagccagguuauaccaauucaucuacuagaggugucuauuauccagacaaaguuuuuaggucuucaauuuuacaucuuacacaagaccuuuucuuaccuuucuuuucuaauguuacuugguuuaacaccauaaauuaucaaggaggcuuuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaagcuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugguaauuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauugcguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacucauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaa

SEQ ID NO: 11731 - RNA, 3822 nt, Artificial Sequence; identical to SEQ ID NO: 136
  SARS-CoV-2/Wuhan/WIV05/2019__EPI_ISL_402128 spike protein CDS gc (1-1273)

SEQ ID NO: 11732 - RNA, 3810 nt, Artificial Sequence
  SARS-CoV-2/bat/Yunnan/RaTG13/2013__EPI_ISL_402131 spike protein CDS gc (1-1269)
auguucguguuccugguccuccugccccuggugagcucccagugcgugaaccucaccacccgcacgcagcugccgcccgccuacaccaacagcuccacccggggcgucuacuaccccgacaagguguuccgcagcuccgugcugcaccucacccaggaccuguuccugcccuucuucagcaacgucacgugguuccacgccauccacguguccgggaccaacggcaucaagcgguucgacaacccggugcuccccuucaacgacggggucuacuucgcgagcaccgagaaguccaacaucauccgcggcuggaucuucgggaccacgcuggacagcaagacccagucccugcucaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccugauggaccucgagggcaagcaggggaacuucaagaaccugcgcgaguucguguucaagaacaucgacggcuacuucaagaucuacuccaagcacacgccgaucaaccugguccgggaccucccgcccggguucagcgcccuggagccccugguggaccuccccaucggcaucaacaucacccgcuuccagacccugcuggcccuccaccgguccuaccugacccccggggacagcagcuccggcuggacggcgggcgccgccgccuacuacgugggguaccugcagccccgcaccuuccuccugaaguacaacgagaacggcaccaucaccgacgcggucgacugcgcccuggacccccucagcgagacgaagugcacccugaaguccuucaccguggagaaggggaucuaccagaccagcaacuuccgggugcagccgacggacuccaucguccgcuuccccaacaucaccaaccugugccccuucggcgagguguucaacgccaccaccuucgccagcgucuacgccuggaaccggaagcgcaucuccaacugcguggcggacuacagcgugcucuacaacuccacgagcuucuccaccuucaagugcuacggcgucagccccaccaagcugaacgaccugugcuucaccaacguguacgccgacuccuucgugaucacgggggacgagguccggcagaucgccccgggccagaccgggaagaucgccgacuacaacuacaagcuccccgacgacuucaccggcugcgugaucgccuggaacagcaagcacaucgacgcgaaggagggcgggaacuucaacuaccuguaccgccuguuccggaaggccaaccucaagcccuucgagcgcgacaucuccaccgagaucuaccaggccggcagcaagcccugcaacgggcagacgggccugaacugcuacuacccgcuguaccgguacggguucuaccccaccgacggcguggggcaccagcccuaccgcgucguggugcucuccuucgagcugcugaacgcccccgccaccgucugcggcccgaagaaguccaccaaccucgugaagaacaagugcgugaacuucaacuucaacggccugaccgggacgggcguccugaccgagagcaacaagaaguuccugcccuuccagcaguucgggcgggacaucgcggacaccaccgacgccgugcgcgacccccagacgcucgagauccuggacaucaccccgugcagcuucggcggggugagcgucaucacccccggcaccaacgccuccaaccagguggccgugcuguaccaggacgucaacugcacggaggugcccguggccauccacgcggaccagcucacccccaccuggcgcgucuacagcaccggcuccaacguguuccagacgcgggccgggugccugaucggcgccgagcacgugaacaacagcuacgagugcgacaucccgaucggggccggcaucugcgcguccuaccagacccagaccaacagccgcuccgucgccagccaguccaucaucgccuacaccaugagccugggcgccgagaacuccguggccuacagcaacaacuccaucgcgauccccacgaacuucaccaucagcgugaccaccgagauccuccccgucuccaugacgaagaccagcguggacugcaccauguacaucugcggggacuccaccgagugcagcaaccugcugcuccaguacggcagcuucugcacgcagcugaaccgggcccugaccgggaucgccguggagcaggacaagaacacccaggaggucuucgcccaggugaagcagaucuacaagacgcccccgaucaaggacuucggcggguucaacuucucccagauccuccccgaccccagcaagcccuccaagcgcagcuucaucgaggaccugcuguucaacaaggugacccucgccgacgcgggcuucaucaagcaguacggcgacugccugggggacaucgccgcccgggaccugaucugcgcccagaaguucaacggccucaccguccugccgccccugcucaccgacgagaugaucgcccaguacaccuccgcgcugcuggccgggacgaucaccagcggcuggaccuucggggccggcgccgcgcuccagauccccuucgccaugcagauggccuaccgcuucaacggcaucggggugacccagaacgugcuguacgagaaccagaagcugaucgccaaccaguucaacuccgccaucggcaagauccaggacagccucuccagcacggcguccgcccuggggaagcugcaggacgucgugaaccagaacgcccaggcccucaacacccuggugaagcagcugagcuccaacuucggcgccaucagcuccguccucaacgacauccugagccggcuggacaagguggaggcggaggugcagaucgaccgccucaucaccgggcggcugcagucccugcagaccuacgucacccagcagcucauccgcgccgccgagauccgggccagcgccaaccuggcggccacgaagauguccgagugcgugcugggccagagcaagcgcguggacuucugcggcaagggguaccaccucaugagcuucccccaguccgccccgcacggcgucguguuccugcacgugaccuacguccccgcccaggagaagaacuucaccaccgcgcccgccaucugccacgacgggaaggcccacuucccccgggagggcguguucgucagcaacgggacgcacugguucgugacccagcgcaacuucuacgagccgcagaucaucaccaccgacaacacguucguguccggcagcugcgacgucgugaucggcaucgugaacaacaccgucuacgacccccugcagcccgagcucgacuccuucaaggaggagcuggacaaguacuucaagaaccacaccagccccgacguggaccugggggacaucuccggcaucaacgccagcguggucaacauccagaaggagaucgaccggcucaacgagguggccaagaaccugaacgagucccugaucgaccuccaggagcuggggaaguacgagcaguacaucaaguggccgugguacaucuggcugggcuucaucgcgggccucaucgccaucaucauggugaccaucaugcugugcugcaugacgagcugcugcuccugccugaaggggugcugcagcugcggcuccugcugcaaguucgacgaggacgacagcgagcccguccucaagggggugaagcugcacuacaccuga

SEQ ID NO: 11733 - RNA, 3822 nt, Artificial Sequence
  SARS-CoV-2/Wuhan/HBCDC-HB-01/2019__EPI_ISL_402132 spike protein CDS gc (1-1273)
auguucguguuccugguccuccugccccuggugagcucccagugcgugaaccucaccacccgcacgcagcugccgcccgccuacaccaacagcaucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11734 - RNA, 3822 nt, Artificial Sequence
  SARS-CoV-2/Guangdong/20SF028/2020__EPI_ISL_403936 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcuguacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11735 - RNA, 3822 nt, Artificial Sequence
  SARS-CoV-2/Shenzhen/SZTH-001/2020__EPI_ISL_406592 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacgugcugaucggcaucgucaacaacacgguguacgacccccugcagcccgagcucgacuccuucaaggaggagcuggacaaguacuucaagaaccacaccagccccgacguggaccugggggacaucuccggcaucaacgccagcgucgugaacauccagaaggagaucgaccgccucaacgagguggccaagaaccugaacgagucccugaucgaccuccaggagcuggggaaguacgagcaguacaucaaguggccgugguacaucuggcugggcuucaucgccggccucaucgcgaucgucauggugaccaucaugcugugcugcaugaccagcugcugcuccugccugaaggggugcugcagcugcggcuccugcugcaaguucgacgaggacgacagcgggcccgugcucaagggcgucaagcugcacuacacguga

SEQ ID NO: 11736 - RNA, 3822 nt, Artificial Sequence
  SARS-CoV-2/Shenzhen/SZTH-004/2020__EPI_ISL_406595 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccugggaccgcaagcggaucuccaacugcguggcguacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11737 - RNA, 3822 nt, Artificial Sequence
  SARS-CoV-2/France/IDF0372/2020__EPI_ISL_406596 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccaggacgugaacugcaccgaggugcccgucgccauccacgccgaccagcugacgcccaccuggcggguguacuccaccggcagcaacguguuccagacccgcgccgggugccucaucggcgcggagcacgucaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcguggccuacuccaacaacagcaucgccauccccaccaacuucacgaucuccgucaccaccgagauccugcccgugagcaugaccaagacgagcguggacugcaccauguacaucugcggggacuccaccgagugcagcaaccuccugcugcaguacggcuccuucugcacccagcucaaccgcgcgcugacggggaucgccgucgagcaggacaagaacacccaggagguguucgcccaggugaagcagaucuacaagacgcccccgaucaaggacuucggcggguucaacuucagccagauccugcccgaccccuccaagcccagcaagcgguccuucaucgaggaccuccuguucaacaaggucacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggugacccagaacguccucuacgagaaccagaagcugaucgccaaccaguucaacagcgccaucggcaagauccaggacucccugagcuccaccgccagcgcgcucgggaagcugcaggacguggugaaccagaacgcccaggcccugaacacgcucgucaagcagcuguccagcaacuucggcgccaucuccagcgugcugaacgacauccucucccgccuggacaagguggaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgccccgcacggcgugguguuccuccacgucacguacgugcccgcccaggagaagaacuucaccaccgcccccgcgaucugccacgacgggaaggcccacuucccccgcgagggcgucuucguguccaacgggacccacugguucgugacgcagcggaacuucuacgagccgcagaucaucaccaccgacaacaccuucgucagcggcaacugcgacguggugaucggcaucgucaacaacacgguguacgacccccugcagcccgagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagcccgugcugaagggggucaagcuccacuacacguga

SEQ ID NO: 11738 - RNA, 3822 nt, Artificial Sequence
  SARS-CoV-2/Australia/VIC01/2020__EPI_ISL_406844 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccggcgcuaccucacgccgggggacuccagcagcggcuggaccgcgggcgccgccgccuacuacgugggguaccugcagccccggaccuuccugcucaaguacaacgagaacggcaccaucacggacgcggucgacugcgcccuggacccccuguccgagaccaagugcacccucaagagcuucaccguggagaaggggaucuaccagacguccaacuuccgcgugcagcccaccgagagcaucguccgguucccgaacaucaccaaccugugccccuucggcgagguguucaacgccacccgcuucgccuccgucuacgccuggaaccggaagcgcaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccggcuguuccgcaaguccaaccucaagcccuucgagcgggacaucagcaccgagaucuaccaggccggcuccacccccugcaacgggguggagggcuucaacugcuacuucccccugcagagcuacggguuccagccgaccaacggcgugggguaccagcccuaccgcguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgggacccccagacccuggagauccucgacaucacccccugcagcuucggcggggugagcgugaucacgccgggcaccaacaccuccaaccaggucgccgugcuguaccaggacgugaacugcaccgagguccccguggccauccacgccgaccagcugacgcccaccuggcgcguguacagcaccggcuccaacgucuuccagacccgggccgggugccucaucggcgcggagcacgugaacaacagcuacgagugcgacauccccaucggggccggcaucugcgccuccuaccagacgcagaccaacagcccgcgccgggcccgcuccguggcgagccaguccaucaucgccuacaccaugagccugggcgccgagaacuccgucgccuacagcaacaacuccaucgccauccccaccaacuucacgaucagcgugaccaccgagauccugcccguguccaugaccaagacgagcgucgacugcaccauguacaucugcggggacagcaccgagugcuccaaccuccugcugcaguacggcagcuucugcacccagcucaaccgggcgcugacggggaucgccguggagcaggacaagaacacccaggagguguucgcccaggucaagcagaucuacaagacgcccccgaucaaggacuucggcggguucaacuucucccagauccugcccgaccccagcaagcccuccaagcgcagcuucaucgaggaccuccuguucaacaaggugacccuggccgacgccggcuucaucaagcaguacggcgacugccucggggacaucgcggcccgggaccugaucugcgcccagaaguucaacggccugaccgugcucccgccccugcugaccgacgagaugaucgcccaguacaccuccgcccuccuggcggggaccaucacgagcggcuggaccuucggggccggcgccgcccugcagauccccuucgcgaugcagauggccuaccgcuucaacggcaucggggucacccagaacgugcucuacgagaaccagaagcugaucgccaaccaguucaacuccgccaucggcaagauccaggacagccuguccagcaccgccuccgcgcucgggaagcugcaggacguggucaaccagaacgcccaggcccugaacacgcucgugaagcagcugagcuccaacuucggcgccaucagcuccgugcugaacgacauccucagccggcuggacaaggucgaggccgaggugcagaucgaccgccugaucaccgggcggcuccagucccugcagaccuacgugacccagcagcugauccgcgcggccgagauccgggccagcgccaaccucgccgcgaccaagaugagcgagugcguccugggccaguccaagcgcguggacuucugcggcaagggguaccaccugaugagcuucccccaguccgccccgcacggcguggucuuccuccacgugacguacguccccgcccaggagaagaacuucaccaccgcccccgcgaucugccacgacgggaaggcccacuucccccgggagggcguguucgugagcaacgggacccacugguucgucacgcagcgcaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccggcugaacgaggucgccaagaaccucaacgagagccugaucgaccugcaggagcucgggaaguacgagcaguacaucaaguggccgugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacguga

SEQ ID NO: 11739 - RNA, 3822 nt, Artificial Sequence
  SARS-CoV-2/Germany/BavPat1/2020__EPI_ISL_406862 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11740 - RNA, 3822 nt, Artificial Sequence
  SARS-CoV-2/Wuhan/HBCDC-HB-02/2020__EPI_ISL_412978 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaacuuccuccugcaguacggcuccuucugcacccagcugaaccgcgcgcucacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccgugcugccgccccuccugaccgacgagaugaucgcccaguacaccagcgcccugcucgcggggaccaucacguccggcuggaccuucggggccggcgccgcccugcagauccccuucgcgaugcagauggccuaccgguucaacggcaucggggucacccagaacgugcuguacgagaaccagaagcucaucgccaaccaguucaacagcgccaucggcaagauccaggacucccugagcuccaccgccagcgcgcuggggaagcuccaggacguggucaaccagaacgcccaggcccugaacacgcuggugaagcagcucuccagcaacuucggcgccaucuccagcgugcugaacgacauccugucccgccucgacaaggucgaggccgaggugcagaucgaccggcugaucaccgggcgccugcagagccuccagaccuacgugacccagcagcugauccgggcggccgagauccgcgccagcgccaaccuggccgcgaccaagauguccgagugcguccucggccagagcaagcggguggacuucugcggcaagggguaccaccugauguccuucccccagagcgccccgcacggcguggucuuccugcacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccuccagcccgagcuggacuccuucaaggaggagcuggacaaguacuucaagaaccacaccagccccgacgucgaccucggggacaucuccggcaucaacgccagcguggugaacauccagaaggagaucgaccgccugaacgaggucgccaagaaccugaacgagucccucaucgaccugcaggagcuggggaaguacgagcaguacaucaaguggccgugguacaucuggcucggcuucaucgccggccugaucgcgaucgugauggugaccaucaugcugugcugcaugaccagcugcugcuccugccucaaggggugcugcagcugcggcuccugcugcaaguucgacgaggacgacagcgagcccguccugaagggggugaagcugcacuacacguga

SEQ ID NO: 11741 - RNA, 3822 nt, Artificial Sequence
  SARS-CoV-2/Australia/QLD02/2020__EPI_ISL_407896 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcuggagcucgacuccuucaaggaggagcuggacaaguacuucaagaaccacaccagccccgacgucgaccugggggacaucuccggcaucaacgccagcguggugaacauccagaaggagaucgaccgccucaacgaggucgccaagaaccugaacgagucccugaucgaccuccaggagcuggggaaguacgagcaguacaucaaguggcccugguacaucuggcugggcuucaucgccggccucaucgcgaucgugauggugaccaucaugcugugcugcaugaccagcugcugcuccugccugaaggggugcugcagcugcggcuccugcugcaaguucgacgaggacgacagcgagccgguccucaagggggugaagcugcacuacacguga

SEQ ID NO: 11742 - RNA, 3822 nt, Artificial Sequence
  SARS-CoV-2/India/1-31/2020__EPI_ISL_413523 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgugaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccgccuggacaagguggaggccgaggugcagaucgaccggcugaucaccgggcgccuccagagccugcagaccuacgucacccagcagcugauccgggccgcggagauccgcgccagcgccaaccucgccgccaccaagauguccgagugcgugcugggccagagcaagcggguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgcgagggcguguucgucuccaacgggacccacugguucgugacgcagcggaacuucuacgagccgcagaucaucaccaccgacaacaccuucgugagcggcaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacguga

SEQ ID NO: 11743 - RNA, 3822 nt, Artificial Sequence
  SARS-CoV-2/Guangdong/GD2020087-P0008/2020__EPI_ISL_413863 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccgggagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11744 - RNA, 3822 nt, Artificial Sequence
  SARS-CoV-2/Sweden/01/2020__EPI_ISL_411951 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacugcggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11745 - RNA, 3822 nt, Artificial Sequence
  SARS-CoV-2/Tianmen/HBCDC-HB-07/2020__EPI_ISL_412983 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggaccugaacugcaccgaggugcccgucgccauccacgccgaccagcucacgcccaccuggcggguguacuccaccggcagcaacguguuccagacccgcgccgggugccugaucggcgcggagcacgucaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcguggccuacuccaacaacagcaucgccauccccaccaacuucacgaucuccgucaccaccgagauccuccccgugagcaugaccaagacgagcguggacugcaccauguacaucugcggggacuccaccgagugcagcaaccugcugcuccaguacggcuccuucugcacccagcugaaccgcgcgcugacggggaucgccgucgagcaggacaagaacacccaggagguguucgcccaggugaagcagaucuacaagacgcccccgaucaaggacuucggcggguucaacuucagccagauccuccccgaccccuccaagcccagcaagcgguccuucaucgaggaccugcuguucaacaaggucacccucgccgacgccggcuucaucaagcaguacggcgacugccugggggacaucgcggcccgcgaccugaucugcgcccagaaguucaacggccucaccgugcugccgccccugcucaccgacgagaugaucgcccaguacaccagcgcccugcuggcggggaccaucacguccggcuggaccuucggggccggcgccgcccuccagauccccuucgcgaugcagauggccuaccgguucaacggcaucggggugacccagaacguccuguacgagaaccagaagcugaucgccaaccaguucaacagcgccaucggcaagauccaggacucccucagcuccaccgccagcgcgcuggggaagcugcaggacguggugaaccagaacgcccaggcccucaacacgcuggucaagcagcuguccagcaacuucggcgccaucuccagcgugcucaacgacauccugucccgccuggacaagguggaggccgagguccagaucgaccggcucaucaccgggcgccugcagagccugcagaccuacgugacccagcagcucauccgggcggccgagauccgcgccagcgccaaccuggccgcgaccaagauguccgagugcgugcugggccagagcaagcgggucgacuucugcggcaagggguaccaccucauguccuucccccagagcgccccgcacggcgugguguuccugcacgucacguacgugcccgcccaggagaagaacuucaccaccgcccccgcgaucugccacgacgggaaggcccacuucccccgcgagggcgucuucguguccaacgggacccacugguucgugacgcagcggaacuucuacgagccgcagaucaucaccaccgacaacaccuucgucagcggcaacugcgacguggugaucggcaucgucaacaacacgguguacgacccccugcagcccgagcucgacuccuucaaggaggagcuggacaaguacuucaagaaccacaccagccccgacguggaccugggggacaucuccggcaucaacgccagcgucgugaacauccagaaggagaucgaccgccucaacgagguggccaagaaccugaacgagucccugaucgaccuccaggagcuggggaaguacgagcaguacaucaaguggccgugguacaucuggcugggcuucaucgccggccucaucgcgaucgucauggugaccaucaugcugugcugcaugaccagcugcugcuccugccugaaggggugcugcagcugcggcuccugcugcaaguucgacgaggacgacagcgagcccgugcucaagggggucaagcugcacuacacguga

SEQ ID NO: 11746 - RNA, 3822 nt, Artificial Sequence
  SARS-CoV-2/Hong Kong/case42_VM20002493/2020__EPI_ISL_414527 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucgcgaucuccgugacgaccgagauccugcccgugagcaugaccaagaccagcgucgacugcacgauguacaucugcggggacuccaccgagugcagcaaccuccugcugcaguacggcuccuucugcacccagcucaaccgcgcccugaccgggaucgccguggagcaggacaagaacacgcaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccagcgcgcuccuggccgggaccaucaccuccggcuggacguucggggccggcgccgcgcugcagauccccuucgccaugcagauggccuaccgguucaacggcaucggggucacccagaacgugcucuacgagaaccagaagcugaucgccaaccaguucaacagcgccaucggcaagauccaggacucccugagcuccaccgcgagcgcccucgggaagcugcaggacguggucaaccagaacgcccaggcccugaacacccucgugaagcagcuguccagcaacuucggcgccaucuccagcgugcugaacgacauccucucccgccuggacaaggucgaggcggaggugcagaucgaccggcugaucacggggcgccuccagagccugcagaccuacgugacccagcagcugauccgggccgccgagauccgcgccagcgccaaccucgcggccaccaagauguccgagugcguccugggccagagcaagcggguggacuucugcggcaagggguaccaccugauguccuucccccagagcgccccgcacggcguggucuuccuccacgugaccuacguccccgcccaggagaagaacuucacgaccgcgcccgccaucugccacgacgggaaggcccacuucccccgcgagggcguguucguguccaacgggacccacugguucgucacccagcggaacuucuacgagccgcagaucaucacgaccgacaacaccuucgugagcggcaacugcgacguggucaucggcaucgugaacaacaccguguacgacccccugcagcccgagcuggacuccuucaaggaggagcucgacaaguacuucaagaaccacacgagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgcgggccugaucgccaucgugauggugaccaucaugcucugcugcaugaccagcugcugcuccugccugaaggggugcugcagcugcggcuccugcugcaaguucgacgaggacgacagcgagcccguccugaagggggugaagcuccacuacaccuga

SEQ ID NO: 11747 - RNA, 3822 nt, Artificial Sequence
  SARS-CoV-2/USA/CruiseA-23/2020__EPI_ISL_414482 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggaggugaagcagggcaacuucaagaaccuccgcgaguucgucuucaagaacaucgacggguacuucaagaucuacuccaagcacaccccgaucaaccuggugcgggaccugccccagggcuucagcgcccucgagccccugguggaccugcccaucgggaucaacaucacccgcuuccagacccuccuggcccugcaccgguccuaccucacgccgggcgacagcagcuccggguggaccgcgggcgccgccgccuacuacgucggcuaccugcagccccgcaccuuccugcucaaguacaacgagaacgggaccaucacggacgcgguggacugcgcccuggacccccugagcgagaccaagugcacccucaaguccuucaccguggagaagggcaucuaccagacgagcaacuuccggguccagcccaccgaguccaucgugcgcuucccgaacaucaccaaccugugccccuucggggaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggcgacgaggugcggcagaucgcccccgggcagaccggcaagaucgccgacuacaacuacaagcugccggacgacuucacggggugcgugaucgcguggaacagcaacaaccucgacuccaaggucggcgggaacuacaacuaccuguaccgccuguuccgcaagagcaaccucaagcccuucgagcgggacaucuccaccgagaucuaccaggccggcagcacccccugcaacggcguggagggguucaacugcuacuucccccugcaguccuacggcuuccagccgaccaacggggugggcuaccagcccuaccgggucguggugcugagcuucgagcuccugcacgcccccgccacggucugcgggcccaagaaguccaccaaccuggugaagaacaagugcgugaacuucaacuucaacggccucaccggcaccgggguccugaccgagagcaacaagaaguuccugccguuccagcaguucggccgcgacaucgccgacacgaccgacgcggugcgcgacccccagacccuggagauccucgacaucacccccugcagcuucgggggcguguccgucaucacgccggggaccaacaccagcaaccagguggccgugcuguaccaggacgucaacugcaccgaggugcccguggccauccacgccgaccagcugacgcccaccuggcgggucuacuccaccggcagcaacguguuccagacccgcgccggcugccucaucggggcggagcacgugaacaacuccuacgagugcgacauccccaucggcgccgggaucugcgccagcuaccagacgcagaccaacuccccgcggcgcgcccggagcgucgcgucccagagcaucaucgccuacaccaugucccugggcgccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggguucaucaagcaguacggcgacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggggccgcccugcagauccccuucgcgaugcagauggccuaccgguucaacggcaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcuggggcagagcaagcggguggacuucugcggcaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggguucaucgccggccugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacguga

SEQ ID NO: 11748 - RNA, 3822 nt, Artificial Sequence
  SARS-CoV-2/Hong Kong/case85_VM20002868/2020__EPI_ISL_414519 spike protein CDS gc (1-1273)
auguucguguuccugguccucgugccccuggugagcucccagugcgucaaccugaccacccgcacgcagcucccgcccgccuacaccaacagcuucacccggggcguguacuaccccgacaagguguuccgcuccagcguccugcacuccacccaggaccuguuccuccccuucuucagcaacgugacgugguuccacgccauccacguguccgggaccaacggcaccaagcgguucgacaacccgguccugcccuucaacgacgggguguacuucgcgagcaccgagaaguccaacaucauccgcggcuggaucuucgggacgacccuggacagcaagacccagucccuccugaucgugaacaacgccaccaacgucgugaucaaggugugcgaguuccaguucugcaacgaccccuuccugggcgucuacuaccacaagaacaacaagagcuggauggaguccgaguuccggguguacagcuccgccaacaacugcacguucgaguacgugagccagcccuuccucauggaccuggagggcaagcaggggaacuucaagaaccugcgcgaguucgucuucaagaacaucgacggcuacuucaagaucuacuccaagcacaccccgaucaaccucgugcgggaccugccccagggguucagcgcccuggagccccucguggaccugcccaucggcaucaacaucacccgcuuccagacccugcucgcccugcaccgguccuaccugacgccgggggacagcagcuccggcuggaccgcgggcgccgccgccuacuacgucggguaccuccagccccgcaccuuccugcugaaguacaacgagaacggcaccaucacggacgcgguggacugcgcccucgacccccugagcgagaccaagugcacccugaaguccuucaccguggagaaggggaucuaccagacgagcaacuuccggguccagcccaccgaguccaucgugcgcuucccgaacaucaccaaccucugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcugaacgaccucugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccuggacuccaaggucgggggcaacuacaacuaccucuaccgccuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccgggucguggugcugagcuucgagcugcuccacgcccccgccacggucugcggccccaagaaguccaccaaccuggugaagaacaagugcgugaacuucaacuucaacggccugaccgggaccggcguccucaccgagagcaacaagaaguuccugccguuccagcaguucgggcgcgacaucgccgacacgaccgacgcggugcgcgacccccagacccuggagauccuggacaucacccccugcagcuucggcgggguguccgucaucacgccgggcaccaacaccagcaaccagguggccgugcucuaccaggacgucaacugcaccgaggugcccguggccauccacgccgaccagcugacgcccaccuggcgggucuacuccaccggcagcaacguguuccagacccgcgccgggugccugaucggcgcggagcacgugaacaacuccuacgagugcgacauccccaucggggccggcaucugcgccagcuaccagacgcagaccaacuccccgcggcgcgcccggagcgucgcgucccagagcaucaucgccuacaccaugucccucggcgccgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccugcuccugcaguacggcuccuucugcacccagcugaaccgcgcgcucacggggaucgccguggagcaggacaagaacacccaggaggucuucgcccaggugaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccguccugccgccccuccugaccgacgagaugaucgcccaguacaccagcgcccugcucgcggggaccaucacguccggcuggaccuucggggccggcgccgcccugcagauccccuucgcgaugcagauggccuaccgguucaacggcaucggggugacccagaacgugcuguacgagaaccagaagcucaucgccaaccaguucaacagcgccaucggcaagauccaggacucccugagcuccaccgccagcgcgcuggggaagcuccaggacgucgugaaccagaacgcccaggcccugaacacgcuggugaagcagcucuccagcaacuucggcgccaucuccagcguccugaacgacauccugucccgccucgacaagguggaggccgaggugcagaucgaccggcugaucaccgggcgccugcagagccuccagaccuacgucacccagcagcugauccgggcggccgagauccgcgccagcgccaaccuggccgcgaccaagauguccgagugcgugcucggccagagcaagcggguggacuucugcggcaagggguaccaccugauguccuucccccagagcgccccgcacggcgucguguuccugcacgucacguacgugcccgcccaggagaagaacuucaccaccgcccccgcgaucugccacgacgggaaggcccacuucccccgcgagggcguguucgucuccaacgggacccacugguucgugacgcagcggaacuucuacgagccgcagaucaucaccaccgacaacaccuucgugagcggcaacugcgacgucgugaucggcaucgugaacaacacggucuacgacccccuccagcccgagcuggacuccuucaaggaggagcuggacaaguacuucaagaaccacaccagccccgacguggaccucggggacaucuccggcaucaacgccagcguggucaacauccagaaggagaucgaccgccugaacgagguggccaagaaccugaacgagucccucaucgaccugcaggagcuggggaaguacgagcaguacaucaaguggccgugguacaucuggcucggcuucaucgccggccugaucgcgaucgugauggucaccaucaugcugugcugcaugaccagcugcugcuccugccucaaggggugcugcagcugcggcuccugcugcaaguucgacgaggacgacagcgagcccgugcugaagggggugaagcugcacuacacguga

SEQ ID NO: 11749 - RNA, 3822 nt, Artificial Sequence
  SARS-CoV-2/England/200990660/2020__EPI_ISL_414523 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcugguccucaagggcgugaagcugcacuacacguga

SEQ ID NO: 11750 - RNA, 3822 nt, Artificial Sequence
  SARS-CoV-2/Australia/NSW09/2020__EPI_ISL_413595 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuucaccgccuccgcgcucgggaagcugcaggacguggucaaccagaacgcccaggcccugaacacgcucgugaagcagcugagcuccaacuucggcgccaucagcuccgugcugaacgacauccucagccgccuggacaaggucgaggccgaggugcagaucgaccggcugaucaccgggcgccuccagucccugcagaccuacgugacccagcagcugauccgggcggccgagauccgcgccagcgccaaccucgccgcgaccaagaugagcgagugcguccugggccaguccaagcggguggacuucugcggcaagggguaccaccugaugagcuucccccaguccgccccgcacggcguggucuuccuccacgugacguacguccccgcccaggagaagaacuucaccaccgcccccgcgaucugccacgacgggaaggcccacuucccccgcgagggcguguucgugagcaacgggacccacugguucgucacgcagcggaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggccgugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacguga

SEQ ID NO: 11751 - RNA, 3822 nt, Artificial Sequence
  SARS-CoV-2/Australia/NSW10/2020__EPI_ISL_413596 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcuucaaguucgacgaggacgacagcgagcccguccugaagggggugaagcuccacuacacguga

SEQ ID NO: 11752 - RNA, 3822 nt, Artificial Sequence
  SARS-CoV-2/Switzerland/1000477797/2020__EPI_ISL_413023 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaacaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11753 - RNA, 3822 nt, Artificial Sequence
  SARS-CoV-2/Belgium/BA-02291/2020__EPI_ISL_415159 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccggcgcagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccgcguggucgugcugagcuucgagcuccugcccgcccccgccacggugugcggcccgaagaaguccaccaaccuggucaagaacaagugcgugaacuucaacuucaacggccucaccgggaccggcgugcugaccgaguccaacaagaaguuccugcccuuccagcaguucgggcgcgacaucgccgacacgaccgacgcgguccgggacccccagacccuggagauccucgacaucaccccgugcagcuucggcgggguguccgugaucacgcccggcaccaacaccagcaaccaggucgccgugcuguaccagggcgugaacugcaccgagguccccguggccauccacgccgaccagcugacgcccaccuggcgcguguacuccaccgggagcaacgucuuccagacccgggccggcugccucaucggggcggagcacgugaacaacuccuacgagugcgacaucccgaucggcgccggcaucugcgccagcuaccagacgcagaccaacagcccccgccgggcccgcagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcgcugacgggcaucgccguggagcaggacaagaacacccaggagguguucgcccaggucaagcagaucuacaagaccccgcccaucaaggacuucgggggcuucaacuucagccagauccugcccgaccccuccaagccgagcaagcgcuccuucaucgaggaccuccuguucaacaaggugacccuggccgacgccggcuucaucaagcaguacggggacugccucggcgacaucgcggcccgggaccugaucugcgcccagaaguucaacgggcugacggugcucccgccccugcugaccgacgagaugaucgcccaguacaccagcgcccuccuggcgggcaccaucacguccggguggaccuucggcgccggcgccgcccugcagauccccuucgcgaugcagauggccuaccgcuucaacgggaucggcgucacccagaacgugcucuacgagaaccagaagcugaucgccaaccaguucaacagcgccaucgggaagauccaggacucccugagcuccgccgcgcccgcccucggcaagcugcaggacguggucaaccagaacgcccaggcccugaacacccucgugaagcagcugagcuccaacuucggggccaucagcuccgugcugaacgacauccucagccggcuggacaaggucgaggcggaggugcagaucgaccgccugaucacgggccggcuccagucccugcagaccuacgugacccagcagcugauccgcgccgccgagauccgggccagcgccaaccucgcggccaccaagaugagcgagugcguccugggccaguccaagcgcguggacuucugcgggaagggcuaccaccugaugagcuucccccaguccgcgccccacgggguggucuuccuccacgugaccuacguccccgcccaggagaagaacuucacgaccgccccggccaucugccacgacggcaaggcccacuucccccgggaggggguguucgugagcaacggcacccacugguucgucacccagcgcaacuucuacgagccccagaucaucacgaccgacaacaccuucguguccggcaacugcgacguggucaucgggaucgugaacaacaccguguacgacccccugcagccggagcuggacagcuucaaggaggagcucgacaaguacuucaagaaccacacgucccccgacgucgaccugggcgacaucagcgggaucaacgccuccguggugaacauccagaaggagaucgaccggcugaacgaggucgccaagaaccucaacgagagccugaucgaccugcaggagcucggcaaguacgagcaguacaucaaguggcccugguacaucuggcugggcuucaucgcggggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacaccuga

SEQ ID NO: 11754 - RNA, 3822 nt, Artificial Sequence
  SARS-CoV-2/USA/WA8-UW5/2020__EPI_ISL_413486 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11755 - RNA, 3822 nt, Artificial Sequence
  SARS-CoV-2/England/20102000506/2020__EPI_ISL_415147 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggguacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11756 - RNA, 3822 nt, Artificial Sequence
  SARS-CoV-2/Belgium/VAG-03013/2020__EPI_ISL_415155 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccacggcgcucggcaagcugcaggacguggucaaccagaacgcccaggcccugaacacccucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgacgaagaugagcgagugcguccugggccaguccaagcggguggacuucugcgggaagggcuaccaccugaugagcuucccccaguccgccccgcacgggguggucuuccuccacgugaccuacguccccgcccaggagaagaacuucaccaccgcccccgcgaucugccacgacggcaaggcccacuucccccgcgaggggguguucgugagcaacggcacgcacugguucgucacccagcggaacuucuacgagccgcagaucaucaccaccgacaacacguucguguccggcaacugcgacguggucaucgggaucgugaacaacaccguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugacguccugcugcagcugccugaagggcugcugcuccugcgggagcugcugcaaguucgacgaggacgacuccgagcccguccugaagggcgugaagcuccacuacaccuga

SEQ ID NO: 11757 - RNA, 3822 nt, Artificial Sequence
  SARS-CoV-2/Belgium/BC-03016/2020__EPI_ISL_415157 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgcccccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccgcaguccgcgccccacgggguggucuuccuccacgugacguacguccccgcccaggagaagaacuucaccaccgcccccgccaucugccacgacggcaaggcccacuucccgcgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccuccccggacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacguga

SEQ ID NO: 11758 - RNA, 3822 nt, Artificial Sequence
  SARS-CoV-2/Germany/BavPat3/2020__EPI_ISL_414521 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccagcaggucuucgcccaggugaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11759 - RNA, 3822 nt, Artificial Sequence
  SARS-CoV-2/France/HF1805/2020__EPI_ISL_414628 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggguggugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacguga

SEQ ID NO: 11760 - RNA, 3822 nt, Artificial Sequence
  SARS-CoV-2/Netherlands/ZuidHolland_9/2020__EPI_ISL_414445 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgugcagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacguga

SEQ ID NO: 11761 - RNA, 3822 nt, Artificial Sequence
  SARS-CoV-2/Finland/FIN03032020A/2020__EPI_ISL_413602 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucagcuggaacuccaacaaccucgacagcaaggucgggggcaacuacaacuaccuguaccgccuguuccggaaguccaaccucaagcccuucgagcgcgacaucagcaccgagaucuaccaggcgggcuccacccccugcaacgggguggagggcuucaacugcuacuucccccugcagagcuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcuccuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccaucaucgcguacaccaugagccugggggccgagaacuccgucgccuacagcaacaacuccaucgccauccccaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgcgcccugacgggcaucgcgguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccgugcucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgucacccagaacgugcucuacgagaaccagaagcugaucgccaaccaguucaacuccgccaucgggaagauccaggacagccuguccagcaccgccuccgcccucggcaagcugcaggacguggucaaccagaacgcgcaggcccugaacacgcucgugaagcagcugagcuccaacuucggggccaucagcuccgugcugaacgacauccucagccgccuggacaaggucgaggccgaggugcagaucgaccggcugaucaccggccgccuccagagccugcagaccuacgugacccagcagcugauccgggccgcggagauccgcgccuccgccaaccucgccgccaccaagaugagcgagugcguccugggccaguccaagcggguggacuucugcgggaagggcuaccaccugaugagcuucccccaguccgcgccgcacgggguggucuuccuccacgugacguacguccccgcccaggagaagaacuucaccaccgcccccgccaucugccacgacggcaaggcgcacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacguga

SEQ ID NO: 11762 - RNA, 3822 nt, Artificial Sequence
  SARS-CoV-2/France/GE1977/2020__EPI_ISL_414632 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccuguucagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacguga

SEQ ID NO: 11763 - RNA, 3822 nt, Artificial Sequence
  SARS-CoV-2/Finland/FIN-313/2020__EPI_ISL_414641 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuucaagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11764 - RNA, 3822 nt, Artificial Sequence
  SARS-CoV-2/Netherlands/ZuidHolland_2/2020__EPI_ISL_414556 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgcccuggagcaggacaagaacacccaggagguguucgcccaggugaagcagaucuacaagacgcccccgaucaaggacuucgggggcuucaacuucagccagauccuccccgaccccuccaagcccagcaagcgguccuucaucgaggaccugcuguucaacaaggucacccucgccgacgccggcuucaucaagcaguacggggacugccugggcgacaucgcggcccgcgaccugaucugcgcccagaaguucaacgggcucaccgugcugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgugacccagaacguccuguacgagaaccagaagcugaucgccaaccaguucaacagcgccaucgggaagauccaggacucccucagcuccaccgccagcgcgcugggcaagcugcaggacguggugaaccagaacgcccaggcccucaacacgcuggucaagcagcuguccagcaacuucggggccaucuccagcgugcucaacgacauccugucccgccuggacaagguggaggccgagguccagaucgaccggcucaucaccggccgccugcagagccugcagaccuacgugacccagcagcucauccgggcggccgagauccgcgccagcgccaaccuggccgcgaccaagauguccgagugcgugcugggccagagcaagcgggucgacuucugcgggaagggcuaccaccucauguccuucccccagagcgccccgcacggggugguguuccugcacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcucgacuccuucaaggaggagcuggacaaguacuucaagaaccacaccagccccgacguggaccugggcgacaucuccgggaucaacgccagcgucgugaacauccagaaggagaucgaccgccucaacgagguggccaagaaccugaacgagucccugaucgaccuccaggagcugggcaaguacgagcaguacaucaaguggccgugguacaucuggcugggcuucaucgccgggcucaucgcgaucgucauggugaccaucaugcugugcugcaugaccagcugcugcuccugccugaagggcugcugcagcugcggguccugcugcaaguucgacgaggacgacagcgagcccgugcucaagggcgucaagcugcacuacacguga

SEQ ID NO: 11765 - RNA, 3822 nt, Artificial Sequence
  SARS-CoV-2/USA/WA-UW31/2020__EPI_ISL_414618 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgcggacacgaccgacgccgugcgcgacccccagacccuggagauccucgacaucacccccugcagcuucggcggggucuccgugaucacgccgggcaccaacaccagcaaccagguggccguccuguaccaggacgugaacugcaccgaggugcccgucgccauccacgccgaccagcugacgcccaccuggcggguguacuccaccggcagcaacguguuccagacccgcgcggggugccucaucggcgccgagcacgucaacaacuccuacgagugcgacauccccaucggggccggcaucugcgccagcuaccagacgcagaccaacuccccgcggcgcgcgcggagcguggccucccagagcaucaucgccuacaccaugucccugggcgccgagaacagcguggccuacuccaacaacagcaucgcgauccccaccaacuucacgaucuccgucaccaccgagauccugcccgugagcaugaccaagacgagcguggacugcaccauguacaucugcggggacuccaccgagugcagcaaccuccugcugcaguacggcuccuucugcacccagcucaaccgcgcccugacggggaucgccgucgagcaggacaagaacacccaggagguguucgcccaggugaagcagaucuacaagacgcccccgaucaaggacuucggcggguucaacuucagccagauccugcccgaccccuccaagcccagcaagcgguccuucaucgaggaccuccuguucaacaaggucacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccagcgcgcuccuggccgggaccaucacguccggcuggaccuucggggccggcgccgcgcugcagauccccuucgccaugcagauggccuaccgguucaacggcaucggggugacccagaacguccucuacgagaaccagaagcugaucgccaaccaguucaacagcgccaucggcaagauccaggacucccugagcuccaccgcgagcgcccucgggaagcugcaggacguggugaaccagaacgcccaggcccugaacacgcucgucaagcagcuguccagcaacuucggcgccaucuccagcgugcugaacgacauccucucccgccuggacaagguggaggcggagguccagaucgaccggcugaucaccgggcgccuccagagccugcagaccuacgugacccagcagcugauccgggccgccgagauccgcgccagcgccaaccucgcggccaccaagauguccgagugcgugcugggccagagcaagcgggucgacuucugcggcaagggguaccaccugauguccuucccccagagcgccccgcacggcgugguguuccuccacgucacguacgugcccgcccaggagaagaacuucaccaccgcgcccgccaucugccacgacgggaaggcccacuucccccgcgagggcgucuucguguccaacgggacccacugguucgugacgcagcggaacuucuacgagccgcagaucaucaccaccgacaacaccuucgucagcggcaacugcgacguggugaucggcaucgucaacaacacgguguacgacccccugcagcccgagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggccgugguacaucuggcugggcuucaucgcgggccugaucgccaucgucauggugaccaucaugcucugcugcaugaccagcugcugcuccugccugaaggggugcugcagcugcggcuccugcugcaaguucgacgaggacgacagcgagcccgugcugaagggggucaagcuccacuacacguga

SEQ ID NO: 11766 - RNA, 3822 nt, Artificial Sequence
  SARS-CoV-2/South Korea/SNU01/2020__EPI_ISL_411929 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucugggcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccgccuguuccggaaguccaaccucaagcccuucgagcgcgacaucagcaccgagaucuaccaggccggcuccacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccaggacgugaacugcaccgagguccccguggccauccacgccgaccagcugacgcccaccuggcggguguacagcaccggcuccaacgucuuccagacccgcgccgggugccucaucggcgcggagcacgugaacaacagcuacgagugcgacauccccaucggggccggcaucugcgccuccuaccagacgcagaccaacagcccgcggcgcgcccgguccguggcgagccaguccaucaucgccuacaccaugagccugggcgccgagaacuccgucgccuacagcaacaacuccaucgccauccccaccaacuucacgaucagcgugaccaccgagauccugcccguguccaugaccaagacgagcgucgacugcaccauguacaucugcggggacagcaccgagugcuccaaccuccugcugcaguacggcagcuucugcacccagcucaaccgcgcgcugacggggaucgccguggagcaggacaagaacacccaggagguguucgcccaggucaagcagaucuacaagacgcccccgaucaaggacuucggcggguucaacuucucccagauccugcccgaccccagcaagcccuccaagcggagcuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccuccgcccuccuggcggggaccaucacgagcggcuggaccuucggggccggcgccgcccugcagauccccuucgcgaugcagauggccuaccgguucaacggcaucggggucacccagaacgugcucuacgagaaccagaagcugaucgccaaccaguucaacuccgccaucggcaagauccaggacagccuguccagcaccgccuccgcgcucgggaagcugcaggacguggucaaccagaacgcccaggcccugaacacgcucgugaagcagcugagcuccaacuucggcgccaucagcuccgugcugaacgacauccucagccgccuggacaaggucgaggccgaggugcagaucgaccggcugaucaccgggcgccuccagucccugcagaccuacgugacccagcagcugauccgggcggccgagauccgcgccagcgccaaccucgccgcgaccaagaugagcgagugcguccugggccaguccaagcggguggacuucugcggcaagggguaccaccugaugagcuucccccaguccgccccgcacggcguggucuuccuccacgugacguacguccccgcccaggagaagaacuucaccaccgcccccgcgaucugccacgacgggaaggcccacuucccccgcgagggcguguucgugagcaacgggacccacugguucgucacgcagcggaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggccgugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacguga

SEQ ID NO: 11767 - RNA, 3822 nt, Artificial Sequence
  SARS-CoV-2/China/WF0004/2020__EPI_ISL_413694 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggacggaguccgaguuccgggucuacagcuccgccaacaacugcaccuucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacgcuccuggcccugcaccgguccuaccucaccccgggggacagcagcuccggcuggaccgcgggcgccgccgccuacuacgugggguaccugcagccccgcaccuuccugcucaaguacaacgagaacggcacgaucaccgacgcggucgacugcgcccuggacccccugagcgagaccaagugcacccucaaguccuucacgguggagaaggggaucuaccagaccagcaacuuccgggugcagcccaccgaguccaucguccgcuucccgaacaucaccaaccugugccccuucggcgagguguucaacgccacgcgguucgccagcgucuacgccuggaaccgcaagcggaucuccaacugcguggcggacuacagcgugcuguacaacuccgccagcuucuccaccuucaagugcuacggcgucagccccaccaagcucaacgaccugugcuucaccaacguguacgccgacuccuucgugauccgcggggacgagguccggcagaucgcccccggccagacggggaagaucgccgacuacaacuacaagcugccggacgacuucaccggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgacgaacggcgugggguaccagcccuaccggguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgcgguccgcgacccccagacccuggagauccucgacaucacgcccugcagcuucggcgggguguccgugaucaccccgggcaccaacaccagcaaccaggucgccgugcuguaccaggacgugaacugcacggagguccccguggccauccacgccgaccagcugacccccaccuggcggguguacuccaccggcagcaacgucuuccagacgcgcgccgggugccucaucggcgcggagcacgugaacaacuccuacgagugcgacauccccaucggggccggcaucugcgccagcuaccagacccagaccaacuccccgcggcgcgcccggagcguggcgucccagagcaucaucgccuacaccaugucccugggcgccgagaacagcgucgccuacuccaacaacagcaucgccauccccacgaacuucaccaucuccgugaccaccgagauccugcccgugagcaugacgaagaccagcgucgacugcaccauguacaucugcggggacuccaccgagugcagcaaccuccugcugcaguacggcuccuucugcacgcagcucaaccgcgcgcugaccgggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggacgaucaccuccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccacggccagcgcgcucgggaagcugcaggacguggucaaccagaacgcccaggcccugaacacccucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgacgaagauguccgagugcguccugggccagagcaagcgguucgacuucugcggcaagggguaccaccugauguccuucccccagagcgccccgcacggcgugguguuccuccacgucaccuacgugcccgcccaggagaagaacuucaccaccgcccccgcgaucugccacgacgggaaggcccacuucccccgcgagggcgucuucguguccaacgggacgcacugguucgugacccagcggaacuucuacgagccgcagaucaucaccaccgacaacacguucgucagcggcaacugcgacguggugaucggcaucgucaacaacaccguguacgacccccugcagcccgagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgcgaucgucauggugaccaucaugcucugcugcaugacgagcugcugcuccugccugaaggggugcugcagcugcggcuccugcugcaaguucgacgaggacgacagcgagcccgugcugaagggggucaagcuccacuacaccuga

SEQ ID NO: 11768 - RNA, 3822 nt, Artificial Sequence
  SARS-CoV-2/China/WF0028/2020__EPI_ISL_413791 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggaguccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11769 - RNA, 3822 nt, Artificial Sequence
  SARS-CoV-2/2019-nCoV/USA-CruiseA-18/2020__MT159716.1 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccucgagggcaagcaggggaacuucaagaaccugcgcgaguucguguucaagaacaucgacggcuacuucaagaucuacuccaagcacaccccgaucaaccugguccgggaccucccccagggguucagcgcccuggagccccugguggaccuccccaucggcaucaacaucacccgcuuccagacccugcuggcccuccaccgguccuaccugacgccgggggacagcagcuccggcuggaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcucuacaacuccgccagcuucuccacguucaagugcuacggcgucagccccaccaagcugaacgaccugugcuucaccaacguguacgccgacuccuucgugauccgcggggacgagguccggcagaucgcccccggccagaccgggaagaucgccgacuacaacuacaagcucccggacgacuucacgggcugcgugaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcucagcuucgagcugcugcacgcccccgccacggugugcggccccaagaaguccaccaaccucgucaagaacaagugcgugaacuucaacuucaacggccugaccgggaccggcgugcugaccgagagcaacaagaaguuccugccguuccagcaguucgggcgcgacaucgccgacacgaccgacgcgguccgcgacccccagacccucgagauccuggacaucacccccugcagcuucggcgggguguccgugaucacgccgggcaccaacaccagcaaccaggucgccgugcuguaccaggacgugaacugcaccgagguccccguggccauccacgccgaccagcucacgcccaccuggcggguguacuccaccggcagcaacgucuuccagacccgcgccgggugccugaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccuccccgugagcaugaccaagacgagcgucgacugcaccauguacaucugcggggacuccaccgagugcagcaaccugcugcuccaguacggcuccuucugcacccagcugaaccgcgcgcugacggggaucgccguggagcaggacaagaacacccaggagguguucgcccaggucaagcagaucuacaagacgcccccgaucaaggacuucggcggguucaacuucagccagauccuccccgaccccuccaagcccagcaagcgguccuucaucgaggaccugcuguucaacaaggugacccucgccgacgccggcuucaucaagcaguacggcgacugccugggggacaucgcggcccgcgaccugaucugcgcccagaaguucaacggccucaccgugcugccgccccugcucaccgacgagaugaucgcccaguacaccagcgcccugcuggcggggaccaucacguccggcuggaccuucggggccggcgccgcccuccagauccccuucgcgaugcagauggccuaccgguucaacggcaucggggucacccagaacgugcuguacgagaaccagaagcugaucgccaaccaguucaacagcgccaucggcaagauccaggacucccucagcuccaccgccagcgcgcuggggaagcugcaggacguggucaaccagaacgcccaggcccucaacacgcuggugaagcagcuguccagcaacuucggcgccaucuccagcgugcucaacgacauccugucccgccuggacaaggucgaggccgaggugcagaucgaccggcucaucaccgggcgccugcagagccugcagaccuacgugacccagcagcucauccgggcggccgagauccgcgccagcgccaaccuggccgcgaccaagauguccgagugcguccugggccagagcaagcggguggacuucugcggcaagggguaccaccucauguccuucccccagagcgccccgcacggcguggucuuccugcacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcucgacuccuucaaggaggagcuggacaaguacuucaagaaccacaccagccccgacgucgaccugggggacaucuccggcaucaacgccagcguggugaacauccagaaggagaucgaccgccucaacgaggucgccaagaaccugaacgagucccugaucgaccuccaggagcuggggaaguacgagcaguacaucaaguggccgugguacaucuggcugggcuucaucgccggccucaucgcgaucgugauggugaccaucaugcugugcugcaugaccagcugcugcuccugccugaaggggugcugcagcugcggcuccugcugcaaguucgacgaggacgacagcgagcccguccucaagggggugaagcugcacuacacguga

SEQ ID NO: 11770 - RNA, 3822 nt, Artificial Sequence
  SARS-CoV-2/SARS-CoV-2/Yunnan-01/human/2020/CHN__MT049951.1 spike protein CDS gc (1-1273)
auguucguguuccugguccuccugccccuggugagcucccagugcgugaaccucaccacccgcacgcagcugccgcccgccaacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11771 - RNA, 3822 nt, Artificial Sequence
  SARS-CoV-2/USA/WA-UW292/2020__EPI_ISL_418077 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccagcuccacccccugcaacggcguggagggguucaacugcuacuucccccugcagagcuacggcuuccagccgaccaacggggugggcuaccagcccuaccggguggucgugcugagcuucgagcuccugcacgcccccgccacggugugcgggcccaagaaguccaccaaccuggucaagaacaagugcgugaacuucaacuucaacggccucaccggcaccggggugcugaccgagagcaacaagaaguuccugccguuccagcaguucggccgcgacaucgccgacacgaccgacgcgguccgcgacccccagacccuggagauccucgacaucacccccugcuccuucgggggcgugagcgugaucacgccggggaccaacaccuccaaccaggucgccgugcuguaccaggacgugaacugcaccgagguccccguggccauccacgccgaccagcugacgcccaccuggcggguguacagcaccggcuccaacgucuuccagacccgcgccggcugccucaucggggcggagcacgugaacaacagcuacgagugcgacauccccaucggcgccgggaucugcgccuccuaccagacgcagaccaacagcccgcggcgcgcccgguccguggcgagccaguccaucaucgccuacaccaugagccugggcgccgagaacuccgucgccuacagcaacaacuccaucgccauccccaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggguucaucaagcaguacggcgacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggggccgcccugcagauccccuucgcgaugcagauggccuaccgguucaacggcaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagagccugcagaccuacgugacccagcagcugauccgggcggccgagauccgcgccuccgccaaccucgccgcgaccaagaugagcgagugcguccuggggcaguccaagcggguggacuucugcggcaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccgggaacugcgacguggucaucggcaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggguucaucgccggccugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacguga

SEQ ID NO: 11772 - RNA, 3822 nt, Artificial Sequence
  SARS-CoV-2/Iceland/192/2020__EPI_ISL_417819 spike protein CDS gc (1-1273)
auguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggaccugccccagggguucagcgcccuggagccccucguggaccugcccaucggcaucaacaucacccgcuuccagacccugcucgcccugcaccgguccuaccugacgccgggggacagcagcuccggcuggaccgcgggcgccgccgccuacuacgugggguaccuccagccccgcaccuuccugcugaaguacaacgagaacggcaccaucacggacgcggucgacugcgcccucgacccccugagcgagaccaagugcacccugaaguccuucaccguggagaaggggaucuaccagacgagcaacuuccgggugcagcccaccgaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcugaacgaccucugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccuggacuccaaggucgggggcaacuacaacuaccucuaccgccuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccggguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgcgacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcggguguacuccaccgggagcaacgucuuccagacccgcgccggcugccugaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccucggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugaccgugcugccgccccuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacaaggucgaggccgaggugcagaucgaccggcugaucaccggccgccugcagagccuccagaccuacgugacccagcagcugauccgggcggccgagauccgcgccagcgccaaccuggccgcgaccaagauguccgagugcguccucggccagagcaagcggguggacuucugcgggaagggcuaccaccugauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccuccagcccgagcuggacuccuucaaggaggagcuggacaaguacuucaagaaccacaccagccccgacgucgaccucggcgacaucuccgggaucaacgccagcguggugaacauccagaaggagaucgaccgccugaacgaggucgccaagaaccugaacgagucccucaucgaccugcaggagcugggcaaguacgagcaguacaucaaguggccgugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagcccguccugaagggcgugaagcugcacuacacguga

SEQ ID NO: 11773 - RNA, 3822 nt, Artificial Sequence
  SARS-CoV-2/Belgium/ULG-6939/2020__EPI_ISL_417020 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucguguacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacguga

SEQ ID NO: 11774 - RNA, 3822 nt, Artificial Sequence
  SARS-CoV-2/France/HF2496/2020__EPI_ISL_418231 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucguggcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacguga

SEQ ID NO: 11775 - RNA, 3822 nt, Artificial Sequence
  SARS-CoV-2/USA/WA-UW291/2020__EPI_ISL_418076 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaguacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11776 - RNA, 3822 nt, Artificial Sequence
  SARS-CoV-2/Portugal/PT0034/2020__EPI_ISL_418019 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaucaccagcugcugcuccugccugaagggcugcugcagcugcggguccugcugcaaguucgacgaggacgacagcgagcccguccugaagggcgugaagcuccacuacacguga

SEQ ID NO: 11777 - RNA, 3822 nt, Artificial Sequence
  SARS-CoV-2/Iceland/202/2020__EPI_ISL_417750 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucccgggcaucaacgccuccguggugaacauccagaaggagaucgaccgccugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacguga

SEQ ID NO: 11778 - RNA, 3822 nt, Artificial Sequence
  SARS-CoV-2/USA/WA-UW261/2020__EPI_ISL_418046 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucacgagcgucuacgccuggaaccgcaagcggaucuccaacugcguggccgacuacagcgugcuguacaacuccgcgagcuucuccaccuucaagugcuacggcgucagccccaccaagcucaacgaccugugcuucaccaacguguacgccgacuccuucgugauccgcggggacgagguccggcagaucgcccccggccagacggggaagaucgccgacuacaacuacaagcugccggacgacuucaccggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgacgaacggcgugggguaccagcccuaccggguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgccguccgcgacccccagacccuggagauccucgacaucacgcccugcagcuucggcgggguguccgugaucaccccgggcaccaacaccagcaaccaggucgcggugcuguaccaggacgugaacugcacggagguccccguggccauccacgccgaccagcugacccccaccuggcggguguacuccaccggcagcaacgucuuccagacgcgcgccgggugccucaucggcgccgagcacgugaacaacuccuacgagugcgacauccccaucggggcgggcaucugcgccagcuaccagacccagaccaacuccccgcggcgcgcccggagcguggccucccagagcaucaucgcguacaccaugucccugggcgccgagaacagcgucgccuacuccaacaacagcaucgccauccccacgaacuucaccaucuccgugaccaccgagauccugcccgugagcaugacgaagaccagcgucgacugcaccauguacaucugcggggacuccaccgagugcagcaaccuccugcugcaguacggcuccuucugcacgcagcucaaccgcgcccugaccgggaucgcgguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgccgcgcgcgaccugaucugcgcccagaaguucaacggccugaccgugcucccgccccugcugaccgacgagaugaucgcccaguacaccagcgcccuccuggccgggacgaucaccuccggcuggaccuucggggcgggcgccgcccugcagauccccuucgccaugcagauggcguaccgguucaacggcaucggggucacccagaacgugcucuacgagaaccagaagcugaucgccaaccaguucaacagcgccaucggcaagauccaggacucccugagcuccacggccagcgcccucgggaagcugcaggacguggucaaccagaacgcgcaggcccugaacacccucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggccgcggagauccgcgccagcgccaaccucgccgccacgaagauguccgagugcguccugggccagagcaagcggguggacuucugcggcaagggguaccaccugauguccuucccccagagcgcgccgcacggcguggucuuccuccacgugaccuacguccccgcccaggagaagaacuucaccaccgcccccgccaucugccacgacgggaaggcgcacuucccccgcgagggcguguucguguccaacgggacgcacugguucgucacccagcggaacuucuacgagccgcagaucaucaccaccgacaacacguucgugagcggcaacugcgacguggucaucggcaucgugaacaacaccguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgccaucgugauggugaccaucaugcucugcugcaugacgagcugcugcuccugccugaaggggugcugcagcugcggcuccugcugcaaguucgacgaggacgacagcgagcccguccugaagggggugaagcuccacuacaccuga

SEQ ID NO: 11779 - RNA, 3822 nt, Artificial Sequence
  SARS-CoV-2/Portugal/PT0035/2020__EPI_ISL_418020 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucagcgcgcgcgaccugaucugcgcccagaaguucaacggccugaccgugcucccgccccugcugaccgacgagaugaucgcccaguacaccuccgcccuccuggccgggaccaucacgagcggcuggaccuucggggcgggcgccgcccugcagauccccuucgccaugcagauggcguaccgguucaacggcaucggggucacccagaacgugcucuacgagaaccagaagcugaucgccaaccaguucaacuccgccaucggcaagauccaggacagccuguccagcaccgccuccgcccucgggaagcugcaggacguggucaaccagaacgcgcaggcccugaacacgcucgugaagcagcugagcuccaacuucggcgccaucagcuccgugcugaacgacauccucagccgccuggacaaggucgaggccgaggugcagaucgaccggcugaucaccgggcgccuccagagccugcagaccuacgugacccagcagcugauccgggccgcggagauccgcgccuccgccaaccucgccgccaccaagaugagcgagugcguccugggccaguccaagcggguggacuucugcggcaagggguaccaccugaugagcuucccccaguccgcgccgcacggcguggucuuccuccacgugacguacguccccgcccaggagaagaacuucaccaccgcccccgccaucugccacgacgggaaggcgcacuucccccgcgagggcguguucgugagcaacgggacccacugguucgucacgcagcggaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggccgugguacaucuggcugggcuucaucgccggccugaucgccaucgugauggugaccaucaugcucugcugcaugaccuccugcugcagcugccugaaggggugcugcuccugcggcagcugcugcaaguucgacgaggacgacuccgagcccguccugaagggggugaagcuccacuacacguga

SEQ ID NO: 11780 - RNA, 3822 nt, Artificial Sequence
  SARS-CoV-2/USA/NY-NYUMC7/2020__EPI_ISL_418192 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11781 - RNA, 3822 nt, Artificial Sequence
  SARS-CoV-2/Iceland/189/2020__EPI_ISL_417709 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaccaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcacgaucaccuccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccacggccagcgcgcucggcaagcugcaggacguggucaaccagaacgcccaggcccugaacacccucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgacgaagauguccgagugcguccugggccagagcaagcggguggacuucugcgggaagggcuaccaccugauguccuucccccagagcgccccgcacgggguggucuuccuccacgugaccuacguccccgcccaggagaagaacuucaccaccgcccccgcgaucugccacgacggcaaggcccacuucccccgcgaggggguguucguguccaacggcacgcacugguucgucacccagcggaacuucuacgagccgcagaucaucaccaccgacaacacguucgugagcggcaacugcgacguggucaucgggaucgugaacaacaccguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugacgagcugcugcuccugccugaagggcugcugcagcugcggguccugcugcaaguucgacgaggacgacagcgagcccguccugaagggcgugaagcuccacuacaccuga

SEQ ID NO: 11782 - RNA, 3822 nt, Artificial Sequence
  SARS-CoV-2/Australia/NSW56/2020__EPI_ISL_417408 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgacuccagcaagcccuccaagcggagcuucaucgaggaccuccuguucaacaaggugacccuggccgacgccggcuucaucaagcaguacggcgacugccucggggacaucgcggcccgcgaccugaucugcgcccagaaguucaacggccugaccgugcugcccccgcuccugaccgacgagaugaucgcccaguacaccuccgcccuccuggcggggaccaucacgagcggcuggaccuucggggccggcgccgcccugcagauccccuucgcgaugcagauggccuaccgguucaacggcaucggggucacccagaacgugcucuacgagaaccagaagcugaucgccaaccaguucaacuccgccaucggcaagauccaggacagccuguccagcaccgccuccgcgcucgggaagcugcaggacguggucaaccagaacgcccaggcccugaacacgcucgugaagcagcugagcuccaacuucggcgccaucagcuccgugcugaacgacauccucagccgccuggacaaggucgaggccgaggugcagaucgaccggcugaucaccgggcgccuccagagccugcagaccuacgugacccagcagcugauccgggcggccgagauccgcgccuccgccaaccucgccgcgaccaagaugagcgagugcguccugggccaguccaagcggguggacuucugcggcaagggguaccaccugaugagcuucccccaguccgcgccccacggcguggucuuccuccacgugacguacgucccggcccaggagaagaacuucaccaccgcccccgccaucugccacgacgggaaggcccacuucccccgcgagggcguguucgugagcaacgggacccacugguucgucacgcagcggaacuucuacgagccccagaucaucaccaccgacaacaccuucguguccggcaacugcgacguggucaucggcaucgugaacaacacgguguacgacccgcugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagccgguccugaagggggugaagcuccacuacacguga

SEQ ID NO: 11783 - RNA, 3822 nt, Artificial Sequence
  SARS-CoV-2/Iceland/280/2020__EPI_ISL_417608 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccacacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11784 - RNA, 3822 nt, Artificial Sequence
  SARS-CoV-2/Iceland/247/2020__EPI_ISL_417575 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11785 - RNA, 3822 nt, Artificial Sequence
  SARS-CoV-2/Iceland/238/2020__EPI_ISL_417566 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgugggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacguga

SEQ ID NO: 11786 - RNA, 3822 nt, Artificial Sequence
  SARS-CoV-2/Greece/16/2020__EPI_ISL_418265 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacgucgacggcuacuucaagaucuacuccaagcacaccccgaucaaccuggugcgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgucggguaccugcagccccgcaccuuccugcucaaguacaacgagaacggcaccaucacggacgcgguggacugcgcccuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgcggugcgcgacccccagacccuggagauccucgacaucacccccugcagcuucggcgggguguccgucaucacgccgggcaccaacaccagcaaccagguggccgugcuguaccaggacgucaacugcaccgaggugcccguggccauccacgccgaccagcugacgcccaccuggcgggucuacuccaccggcagcaacguguuccagacccgcgccgggugccucaucggcgcggagcacgugaacaacuccuacgagugcgacauccccaucggggccggcaucugcgccagcuaccagacgcagaccaacuccccgcggcgcgcccggagcgucgcgucccagagcaucaucgccuacaccaugucccugggcgccgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgcgcgcugacggggaucgccguggagcaggacaagaacacccaggaggucuucgcccaggugaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccguccucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggugacccagaacgugcucuacgagaaccagaagcugaucgccaaccaguucaacagcgccaucggcaagauccaggacucccugagcuccaccgccagcgcgcucgggaagcugcaggacgucgugaaccagaacgcccaggcccugaacacgcucgugaagcagcuguccagcaacuucggcgccaucuccagcguccugaacgacauccucucccgccuggacaagguggaggccgaggugcagaucgaccggcugaucaccgggcgccuccagagccugcagaccuacgucacccagcagcugauccgggcggccgagauccgcgccagcgccaaccucgccgcgaccaagauguccgagugcgugcugggccagagcaagcggguggacuucugcggcaagggguaccaccugauguccuucccccagagcgccccgcacggcgucguguuccuccacgucacguacgugcccgcccaggagaagaacuucaccaccgcccccgcgaucugccacgacgggaaggcccacuucccccgcgagggcguguucgucuccaacgggacccacugguucgugacgcagcggaacuucuacgagccgcagaucaucaccaccgacaacaccuucgugagcggcaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgcgaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacguga

SEQ ID NO: 11787 - RNA, 3822 nt, Artificial Sequence
  SARS-CoV-2/Iceland/319/2020__EPI_ISL_417648 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugaucgaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11788 - RNA, 3822 nt, Artificial Sequence
  SARS-CoV-2/Congo/94/2020__EPI_ISL_417947 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggacauccucuucaacaaggugacccuggccgacgccggcuucaucaagcaguacggggacugccugggcgacaucgcggcccgcgaccucaucugcgcccagaaguucaacgggcugaccgugcugccgccccuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacaaggucgaggccgaggugcagaucgaccggcugaucaccggccgccugcagagccuccagaccuacgugacccagcagcugauccgggcggccgagauccgcgccagcgccaaccuggccgcgaccaagauguccgagugcguccucggccagagcaagcggguggacuucugcgggaagggcuaccaccugauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccuccagcccgagcuggacuccuucaaggaggagcuggacaaguacuucaagaaccacaccagccccgacgucgaccucggcgacaucuccgggaucaacgccagcguggugaacauccagaaggagaucgaccgccugaacgaggucgccaagaaccugaacgagucccucaucgaccugcaggagcugggcaaguacgagcaguacaucaaguggccgugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagcccguccugaagggcgugaagcugcacuacacguga

SEQ ID NO: 11789 - RNA, 3822 nt, Artificial Sequence
  SARS-CoV-2/Congo/158/2020__EPI_ISL_417950 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuuccugagcggcaacugcgacguggugaucggcaucgucaacaacacgguguacgacccccugcagcccgagcucgacuccuucaaggaggagcuggacaaguacuucaagaaccacaccagccccgacguggaccugggggacaucuccggcaucaacgccagcgucgugaacauccagaaggagaucgaccgccucaacgagguggccaagaaccugaacgagucccugaucgaccuccaggagcuggggaaguacgagcaguacaucaaguggccgugguacaucuggcugggcuucaucgccggccucaucgcgaucgucauggugaccaucaugcugugcugcaugaccagcugcugcuccugccugaaggggugcugcagcugcggcuccugcugcaaguucgacgaggacgacagcgagcccgugcucaagggggucaagcugcacuacacguga

SEQ ID NO: 11790 - RNA, 3822 nt, Artificial Sequence
  SARS-CoV-2/USA/UT-00034/2020__EPI_ISL_417977 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuacuacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacguga

SEQ ID NO: 11791 - RNA, 3822 nt, Artificial Sequence
  SARS-CoV-2/USA/UT-00033/2020__EPI_ISL_417976 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcucuacaacuccgccagcuucuccacguucaagugcuacggcgucagccccaccaagcugaacgaccugugcuucaccaacguguacgccgacuccuucgugauccgcggggacgagguccggcagaucgcccccggccagaccgggaagaucgccgacuacaacuacaagcucccggacgacuucacgggcugcgugaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcucagcuucgagcugcugcacgcccccgccacggugugcggccccaagaaguccaccaaccucgucaagaacaagugcgugaacuucaacuucaacggccugaccgggaccggcgugcugaccgagagcaacaagaaguuccugccguuccagcaguucgggcgcgacaucgccgacacgaccgacgcgguccgcgacccccagacccucgagauccuggacaucacccccugcagcuucggcgggguguccgugaucacgccgggcaccaacaccagcaaccaggucgccgugcuguaccagggcgugaacugcaccgagguccccguggccauccacgccgaccagcucacgcccaccuggcggguguacuccaccgggagcaacgucuuccagacccgcgccggcugccugaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccuccccgugagcaugaccaagacgagcgucgacugcaccauguacaucugcggcgacuccaccgagugcagcaaccugcugcuccaguacggguccuucugcacccagcugaaccgcgcgcugacgggcaucgccguggagcaggacaagaacacccaggagguguucgcccaggucaagcagaucuacaagacgcccccgaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucaccgugcugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgucacccagaacgugcuguacgagaaccagaagcugaucgccaaccaguucaacagcgccaucgggaagauccaggacucccucagcuccaccgccagcgcgcugggcaagcugcaggacguggucaaccagaacgcccaggcccucaacacgcuggugaagcagcuguccagcaacuucggggccaucuccagcgugcucaacgacauccugucccgccuggacaaggucgaggccgaggugcagaucgaccggcucaucaccggccgccugcagagccugcagaccuacgugacccagcagcucauccgggcggccgagauccgcgccagcgccaaccuggccgcgaccaagauguccgagugcguccugggccagagcaagcggguggacuucugcgggaagggcuaccaccucauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcucgacuccuucaaggaggagcuggacaaguacuucaagaaccacaccagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacacguga

SEQ ID NO: 11792 - RNA, 3822 nt, Artificial Sequence
  SARS-CoV-2/USA/WI-13/2020__EPI_ISL_417516 spike protein CDS gc (1-1273)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcugcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcucuacaacuccgccagcuucuccacguucaagugcuacggcgucagccccaccaagcugaacgaccugugcuucaccaacguguacgccgacuccuucgugauccgcggggacgagguccggcagaucgcccccggccagaccgggaagaucgccgacuacaacuacaagcucccggacgacuucacgggcugcgugaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcucagcuucgagcugcugcacgcccccgccacggugugcggccccaagaaguccaccaaccucgucaagaacaagugcgugaacuucaacuucaacggccugaccgggaccggcgugcugaccgagagcaacaagaaguuccugccguuccagcaguucgggcgcgacaucgccgacacgaccgacgcgguccgcgacccccagacccucgagauccuggacaucacccccugcagcuucggcgggguguccgugaucacgccgggcaccaacaccagcaaccaggucgccgugcuguaccagggcgugaacugcaccgagguccccguggccauccacgccgaccagcucacgcccaccuggcggguguacuccaccgggagcaacgucuuccagacccgcgccggcugccugaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccuccccgugagcaugaccaagacgagcgucgacugcaccauguacaucugcggcgacuccaccgagugcagcaaccugcugcuccaguacggguccuucugcacccagcugaaccgcgcgcugacgggcaucgccguggagcaggacaagaacacccaggagguguucgcccaggucaagcagaucuacaagacgcccccgaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucaccgugcugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgucacccagaacgugcuguacgagaaccagaagcugaucgccaaccaguucaacagcgccaucgggaagauccaggacucccucagcuccaccgccagcgcgcugggcaagcugcaggacguggucaaccagaacgcccaggcccucaacacgcuggugaagcagcuguccagcaacuucggggccaucuccagcgugcucaacgacauccugucccgccuggacaaggucgaggccgaggugcagaucgaccggcucaucaccggccgccugcagagccugcagaccuacgugacccagcagcucauccgggcggccgagauccgcgccagcgccaaccuggccgcgaccaagauguccgagugcguccugggccagagcaagcggguggacuucugcgggaagggcuaccaccucauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcucgacuccuucaaggaggagcuggacaaguacuucaagaaccacaccagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacacguga

SEQ ID NO: 11793 - RNA, 3819 nt, Artificial Sequence
  SARS-CoV-2/India/1-27/2020__EPI_ISL_413522 spike protein CDS gc (1-1272)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgaggucauccagaucgcccccggccagaccgggaagaucgccgacuacaacuacaagcugccggacgacuucacgggcugcgugaucgcguggaacagcaacaaccucgacuccaaggucgggggcaacuacaacuaccuguaccggcuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgggacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggggccggcaucugcgccagcuaccagacgcagaccaacuccccgcgccgggcccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgggcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgcuccuucaucgaggaccuccuguucaacaaggugacccuggccgacgccggcuucaucaagcaguacggcgacugccucggggacaucgcggcccgggaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgcuucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccggcuggacaaggucgaggccgaggugcagaucgaccgccugaucaccgggcggcuccagagccugcagaccuacgugacccagcagcugauccgcgcggccgagauccgggccagcgccaaccucgccgcgaccaagauguccgagugcguccugggccagagcaagcgcguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgggagggcguguucguguccaacgggacccacugguucgucacgcagcgcaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11794 - RNA, 3804 nt, Artificial Sequence
  SARS-CoV-2/pangolin/Guangxi/P4L/2017__EPI_ISL_410538 spike protein CDS gc (1-1267)
auguucguguuccuguucguccucccccuggugagcucccagugcgugaaccugaccacccgcacgggcaucccgcccggguacaccaacagcuccacccggggcgucuacuaccccgacaagguguuccgcagcuccauccuccaccugacccaggaccuguuccuccccuucuucagcaacgugacgugguucaacaccaucaacuaccagggcggguucaagaaguucgacaacccgguccugcccuucaacgacgggguguacuucgccuccaccgagaaguccaacaucauccggggcuggaucuucggcaccacgcuggacgcccgcacccagagccuccugaucgugaacaacgcgaccaacgucgugaucaaggugugcgaguuccaguucugcaccgaccccuuccugggggucuacuaccacaacaacaacaagacguggguggagaacgaguuccggguguacagcuccgccaacaacugcaccuucgaguacaucagccagcccuuccucauggaccuggagggcaagcaggggaacuucaagaaccugcgcgaguucgucuucaagaacguggacggcuacuucaagaucuacuccaagcacaccccgaucgaccucgugcgggaccugccccgcggguucgccgcccuggagccccucgucgaccugcccaucggcaucaacaucacccgguuccagacgcugcucgcccugcaccgcagcuaccugaccccgggcaaccucgaguccggguggaccaccggcgcggccgccuacuacgugggguaccugcagcagcggacguuccugcucagcuacaaccagaacggcaccaucaccgacgccguggacugcucccuggacccccugagcgagaccaagugcacgcucaagucccugaccgucgagaagggcaucuaccagaccagcaacuuccgcgugcagcccaccaucagcaucgugcgguuccccaacaucacgaaccugugcccguucggggaggucuucaacgcguccaaguucgccagcguguacgccuggaaccgcaagcggaucuccaacugcgucgccgacuacagcgugcucuacaacuccaccagcuucuccaccuucaagugcuacggcgugagccccaccaagcugaacgaccugugcuucacgaacgucuacgccgacuccuucguggugaagggggacgagguccgccagaucgcgcccggccagaccggggugaucgccgacuacaacuacaagcuccccgacgacuucaccggcugcgugaucgccuggaacagcgucaagcaggacgcccugaccggcgggaacuacggcuaccuguaccgccucuuccggaaguccaagcugaagccguucgagcgggacaucagcacggagaucuaccaggccggguccacccccugcaacggccagguggggcugaacugcuacuacccccucgagcgcuacggcuuccaccccaccaccggcgugaacuaccagccguuccgggucguggugcugagcuucgagcugcucaacgggcccgcgaccgucugcggccccaagcuguccacgacccuggugaaggacaagugcgugaacuucaacuucaacgggcugaccggcaccgggguccucacgaccagcaagaagcaguuccugcccuuccagcaguucggccgcgacaucuccgacaccaccgacgccgugcgcgacccgcagacgcuggagauccucgacaucacccccugcagcuucggcgggguguccgucaucacccccggcaccaacacgagcaaccagguggccgugcuguaccaggacgucaacugcaccgaggugccgauggccauccacgccgagcagcugacccccgcguggcggguguacagcgccggggccaacgucuuccagacccgcgccggcugccucgugggcgccgagcacgugaacaacuccuacgagugcgacauccccgucggggcgggcaucugcgccagcuaccacuccaugagcucccugcggagcgugaaccagcgcuccaucaucgccuacacgaugagccugggggccgagaacuccguggcguacagcaacaacuccaucgccauccccaccaacuucaccaucagcgucaccacggagauccucccgguguccaugaccaagaccagcguggacugcaccauguacaucugcggcgacuccaucgagugcagcaaccugcugcuccaguacggguccuucugcacgcagcugaaccgggcccugaccggcaucgccgucgagcaggacaagaacacccaggagguguucgcccaggugaagcagaucuacaagaccccgcccaucaaggacuucggcggguucaacuucagccagauccuccccgaccccagcaagcccuccaagcgcagcuucaucgaggaccugcuguucaacaaggucacgcucgcggacgccggcuucaucaagcaguacggggacugccugggcgacaucgccgcccgggaccugaucugcgcccagaaguucaacgggcucaccgugcugccgccccugcucaccgacgagaugaucgcgcaguacaccuccgcccugcuggccggcacgaucaccagcggcuggaccuucggggccggcgccgcgcuccagauccccuucgccaugcagauggccuaccgcuucaacgggaucggcgugacccagaacguccuguacgagaaccagaagcugaucgccaaccaguucaacuccgcgaucgggaagauccaggacagccucuccagcacggccuccgcccugggcaagcugcaggacguggugaaccagaacgcccaggcccucaacacccuggucaagcagcugagcuccaacuucggcgcgaucagcuccgugcucaacgacauccugagccggcuggacaagguggaggccgagguccagaucgaccgccucaucaccgggcggcugcagucccugcagaccuacgugacccagcagcucauccgcgccgccgagauccgggccagcgcgaaccuggccgccacgaagauguccgagugcgugcugggccagagcaagcgcgucgacuucugcgggaagggcuaccaccucauguccuucccccagagcgcgccccacgggguggucuuccugcacgugaccuacgugcccgcccaggagaagaacuucaccaccgccccggccaucugccacgagggcaaggcccacuucccccgggagggcgucuucgugagcaacgggacgcacugguucaucacccagcgcaacuucuacgagccccagaucaucaccaccgacaacacguucguguccggcagcugcgacgucgugaucgggaucgugaacaacaccgucuacgacccccugcagccggagcucgacuccuucaaggaggagcuggacaaguacuucaagaaccacaccagccccgacguggaccugggcgacaucuccggcaucaacgccagcguggucaacauccagaaggagaucgaccggcucaacgagguggcgaagaaccugaacgagucccccaucgaccugcaggagcucgggaaguacgagcaguacaucaaguggcccugguacaucuggcugggcuucaucgccgggcugaucgccaucaucauggugaccaucaugcucugcugcaugacgagcugcugcuccugccugaagggcugcugcagcugcggguccugcugcaaguucgacgaggacgacagcgagccgguccugaagggcgugaagcuccacuacaccuga

SEQ ID NO: 11795 - RNA, 3804 nt, Artificial Sequence
  SARS-CoV-2/pangolin/Guangxi/P5L/2017__EPI_ISL_410540 spike protein CDS gc (1-1267)
auguucguguuccuguucguccucccccuggugagcucccagugcgugaaccugaccacccgcacgggcaucccgcccggguacaccaacagcuccacccggggcgucuacuaccccgacaagguguuccgcagcuccauccuccaccugacccaggaccuguuccuccccuucuucagcaacgugacgugguucaacaccaucaacuaccagggcggguucaagaaguucgacaacccgguccugcccuucaacgacgggguguacuucgccuccaccgagaaguccaacaucauccggggcuggaucuucggcaccacgcuggacgcccgcacccagagccuccugaucgugaacaacgcgaccaacgucgugaucaaggugugcgaguuccaguucugcaccgaccccuuccugggggucuacuaccacaacaacaacaagacguggguggagaacgaguuccggguguacagcuccgccaacaacugcaccuucgaguacaucagccagcccuuccucauggaccuggagggcaagcaggggaacuucaagaaccugcgcgaguucgucuucaagaacguggacggcuacuucaagaucuacuccaagcacaccccgaucgaccucgugcgggaccugccccgcggguucgccgcccuggagccccucgucgaccugcccaucggcaucaacaucacccgguuccagacgcugcucgcccugcaccgcagcuaccugaccccgggcaagcucgaguccggguggaccaccggcgcggccgccuacuacgugggguaccugcagcagcggacguuccugcucagcuacaaccagaacggcaccaucaccgacgccguggacugcucccuggacccccugagcgagaccaagugcacgcucaagucccugaccgucgagaagggcaucuaccagaccagcaacuuccgcgugcagcccaccaucagcaucgugcgguuccccaacaucacgaaccugugcccguucggggaggucuucaacgcguccaaguucgccagcguguacgccuggaaccgcaagcggaucuccaacugcgucgccgacuacagcgugcucuacaacuccaccagcuucuccaccuucaagugcuacggcgugagccccaccaagcugaacgaccugugcuucacgaacgucuacgccgacuccuucguggugaagggggacgagguccgccagaucgcgcccggccagaccggggugaucgccgacuacaacuacaagcuccccgacgacuucaccggcugcgugaucgccuggaacagcgucaagcaggacgcccugaccggcgggaacuacggcuaccuguaccgccucuuccggaaguccaagcugaagccguucgagcgggacaucagcacggagaucuaccaggccggguccacccccugcaacggccagguggggcugaacugcuacuacccccucgagcgcuacggcuuccaccccaccaccggcgugaacuaccagccguuccgggucguggugcugagcuucgagcugcucaacgggcccgcgaccgucugcggccccaagcuguccacgacccuggugaaggacaagugcgugaacuucaacuucaacgggcugaccggcaccgggguccucacgaccagcaagaagcaguuccugcccuuccagcaguucggccgcgacaucuccgacaccaccgacgccgugcgcgacccgcagacgcuggagauccucgacaucacccccugcagcuucggcgggguguccgucaucacccccggcaccaacacgagcaaccagguggccgugcuguaccaggacgucaacugcaccgaggugccgauggccauccacgccgagcagcugacccccgcguggcggguguacagcgccggggccaacgucuuccagacccgcgccggcugccucgugggcgccgagcacgugaacaacuccuacgagugcgacauccccgucggggcgggcaucugcgccagcuaccacuccaugagcuccuuccggagcgugaaccagcgcuccaucaucgccuacacgaugagccugggggccgagaacuccguggcguacagcaacaacuccaucgccauccccaccaacuucaccaucagcgucaccacggagauccugccgguguccaugaccaagaccagcguggacugcaccauguacaucugcggcgacuccaucgagugcagcaaccuccugcugcaguacggguccuucugcacgcagcucaaccgggcccugaccggcaucgccgucgagcaggacaagaacacccaggagguguucgcccaggugaagcagaucuacaagaccccgcccaucaaggacuucggcggguucaacuucagccagauccugcccgaccccagcaagcccuccaagcgcagcuucaucgaggaccuccuguucaacaaggucacgcuggcggacgccggcuucaucaagcaguacggggacugccucggcgacaucgccgcccgggaccugaucugcgcccagaaguucaacgggcugaccgugcucccgccccugcugaccgacgagaugaucgcgcaguacaccuccgcccuccuggccggcacgaucaccagcggcuggaccuucggggccggcgccgcgcugcagauccccuucgccaugcagauggccuaccgcuucaacgggaucggcgugacccagaacguccucuacgagaaccagaagcugaucgccaaccaguucaacuccgcgaucgggaagauccaggacagccuguccagcacggccuccgcccucggcaagcugcaggacguggugaaccagaacgcccaggcccugaacacccucgucaagcagcugagcuccaacuucggcgcgaucagcuccgugcugaacgacauccucagccggcuggacaagguggaggccgagguccagaucgaccgccugaucaccgggcggcuccagucccugcagaccuacgugacccagcagcugauccgcgccgccgagauccgggccagcgcgaaccucgccgccacgaagauguccgagugcgugcugggccagagcaagcgcgucgacuucugcgggaagggcuaccaccugauguccuucccccagagcgcgccccacgggguggucuuccuccacgugaccuacgugcccgcccaggagaagaacuucaccaccgccccggccaucugccacgagggcaaggcccacuucccccgggagggcgucuucgugagcaacgggacgcacugguucaucacccagcgcaacuucuacgagccccagaucaucaccaccgacaacacguucguguccggcagcugcgacgucgugaucgggaucgugaacaacaccgucuacgacccccugcagccggagcuggacuccuucaaggaggagcucgacaaguacuucaagaaccacaccagccccgacguggaccugggcgacaucuccggcaucaacgccagcguggucaacauccagaaggagaucgaccggcugaacgagguggcgaagaaccucaacgagucccugaucgaccugcaggagcucgggaaguacgagcaguacaucaaguggcccugguacaucuggcugggcuucaucgccgggcugaucgccaucaucauggugaccaucaugcucugcugcaugacgagcugcugcuccugccugaagggcugcugcagcugcggguccugcugcaaguucgacgaggacgacagcgagcccguccugaagggcgugaagcuccacuacaccuga

SEQ ID NO: 11796 - RNA, 3804 nt, Artificial Sequence
  SARS-CoV-2/pangolin/Guangxi/P5E/2017__EPI_ISL_410541 spike protein CDS gc (1-1267)
auguucguguuccuguucguccucccccuggugagcucccagugcgugaaccugaccacccgcacgggcaucccgcccggguacaccaacagcuccacccggggcgucuacuaccccgacaagguguuccgcagcuccauccuccaccugacccaggaccuguuccuccccuucuucagcaacgugacgugguucaacaccaucaccuaccagggcggguccaagaaguucgacaacccgguccugcccuucaacgacgggguguacuucgccagcaccgagaaguccaacaucauccggggcuggaucuucggcacgacccuggacgcccgcacccagagccuccugaucgugaacaacgcgaccaacgucgugaucaaggugugcgaguuccaguucugcacggaccccuuccugggggucuacuaccacaacaacaacaagaccuggguggagaacgaguuccggguguacuccagcgccaacaacugcaccuucgaguacaucucccagcccuuccucauggaccuggagggcaagcaggggaacuucaagaaccugcgcgaguucgucuucaagaacguggacggcuacuucaagaucuacagcaagcacaccccgaucgaccucgugcgggaccugccccgcggguucgccgcccuggagccccucgucgaccugcccaucggcaucaacaucacgcgguuccagacccugcucgcccugcaccgcuccuaccugaccccgggcaagcucgagagcggguggaccacgggcgcggccgccuacuacgugggguaccugcagcagcggaccuuccugcucuccuacaaccagaacggcaccaucaccgacgccguggacugcagccuggacccccuguccgagacgaagugcacccucaagagccugaccgucgagaagggcaucuaccagaccagcaacuuccgcgugcagcccacgaucuccaucgugcgguuccccaacaucaccaaccugugcccguucggggaggucuucaacgcgagcaaguucgccuccguguacgccuggaaccgcaagcggaucagcaacugcgucgccgacuacuccgugcucuacaacagcaccuccuucagcaccuucaagugcuacggcgugucccccacgaagcugaacgaccugugcuucaccaacgucuacgccgacagcuucguggugaagggggacgagguccgccagaucgcgcccggccagaccggggugaucgccgacuacaacuacaagcuccccgacgacuucaccggcugcgugaucgccuggaacuccgucaagcaggacgcccugacgggcgacaacuacggguaccuguaccggcuguuccgcaagagcaagcucaagccguucgagcgggacaucuccaccgagaucuaccaggccggcagcacccccugcaacggccagguggggcugaacugcuacuacccccucgagcgcuacggguuccaccccaccaccggcgugaacuaccagccguuccgggucguggugcuguccuucgagcugcucaacggccccgcgacggucugcgggcccaagcugagcaccacccuggugaaggacaagugcgugaacuucaacuucaacggccugaccgggacgggcguccucaccaccuccaagaagcaguuccugcccuuccagcaguucgggcgcgacaucagcgacaccacggacgccgugcgcgacccgcagacccuggagauccucgacaucacccccugcuccuucggcggcgugagcgucaucacccccgggacgaacaccagcaaccagguggccgugcuguaccaggacgucaacugcaccgaggugccgauggccauccacgccgagcagcugacccccgcguggcggguguacuccgccggcgccaacgucuuccagacgcgcgccgggugccucgugggcgccgagcacgugaacaacagcuacgagugcgacauccccgucggcgcggggaucugcgccuccuaccacagcauguccagcuuccgguccgugaaccagcgcagcaucaucgccuacaccaugucccugggcgccgagaacagcguggcguacuccaacaacagcaucgccauccccaccaacuucaccaucuccgucacgaccgagauccugccggugagcaugaccaagaccuccguggacugcacgauguacaucugcggggacagcaucgagugcuccaaccuccugcugcaguacggcagcuucugcacccagcucaaccgggcccugaccgggaucgccgucgagcaggacaagaacacccaggagguguucgcccaggugaagcagaucuacaagacgccgcccaucaaggacuucggcggcuucaacuucagccagauccugcccgaccccuccaagcccagcaagcgcuccuucaucgaggaccuccuguucaacaaggucacccuggcggacgccggguucaucaagcaguacggcgacugccucggggacaucgccgcccgggaccugaucugcgcccagaaguucaacggccugaccgugcucccgccccugcugaccgacgagaugaucgcgcaguacacgagcgcccuccuggccgggaccaucaccuccggcuggaccuucggcgccggggccgcgcugcagauccccuucgccaugcagauggccuaccgcuucaacggcaucggggugacgcagaacguccucuacgagaaccagaagcugaucgccaaccaguucaacagcgcgaucggcaagauccaggacucccugagcuccaccgccagcgcccucgggaagcugcaggacguggugaaccagaacgcccaggcccugaacacccucgucaagcagcuguccagcaacuucggcgcgaucuccagcgugcugaacgacauccucucccggcuggacaagguggaggccgagguccagaucgaccgccugaucaccggccggcuccagagccugcagaccuacgugacgcagcagcugauccgcgccgccgagauccgggccuccgcgaaccucgccgccaccaagaugagcgagugcgugcuggggcaguccaagcgcgucgacuucugcggcaagggguaccaccugaugagcuucccccagagcgcgccccacggcguggucuuccuccacgugaccuacgugcccgcccaggagaagaacuucaccacggccccggccaucugccacgaggggaaggcccacuucccccgggagggcgucuucguguccaacggcacccacugguucaucacccagcgcaacuucuacgagccccagaucaucaccacggacaacaccuucgugagcggguccugcgacgucgugaucggcaucgugaacaacaccgucuacgacccccugcagccggagcuggacagcuucaaggaggagcucgacaaguacuucaagaaccacaccucccccgacguggaccugggggacaucagcggcaucaacgccuccguggucaacauccagaaggagaucgaccggcugaacgagguggcgaagaaccucaacgagagccugaucgaccugcaggagcucggcaaguacgagcaguacaucaaguggcccugguacaucuggcugggguucaucgccggccugaucgccaucaucauggugacgaucaugcucugcugcaugaccuccugcugcagcugccugaaggggugcugcuccugcggcagcugcugcaaguucgacgaggacgacuccgagcccguccugaagggggugaagcuccacuacaccuga

SEQ ID NO: 11797 - RNA, 3798 nt, Artificial Sequence
  SARS-CoV-2/pangolin/Guangxi/P1E/2017__EPI_ISL_410539 spike protein CDS gc (1-1265)
auguucguguuccuguucguccucccccuggugagcucccagugcgugaaccugaccacccgcacgggcauccagccgggguacaccaacagcuccacccggggcgucuacuaccccgacaagguguuccgcagcuccauccuccaccugacccaggaccuguuccuccccuucuucagcaacgugacgugguucaacaccaucaacuaccagggcggguucaagaaguucgacaaccccguccugccguucaacgacgggguguacuucgccuccaccgagaaguccaacaucauccggggcuggaucuucggcaccacgcuggacgcccgcacccagagccuccugaucgugaacaacgcgaccaacgucgugaucaaggugugcgaguuccaguucugcaccgaccccuuccugggggucuacuaccacaacaacaacaagacguggguggagaacgaguuccggguguacagcuccgccaacaacugcaccuucgaguacaucagccagcccuuccucauggaccuggagggcaagcaggggaacuucaagaaccugcgcgaguucgucuucaagaacguggacggcuacuucaagaucuacuccaagcacacccccaucgaccucgugcgggaccugccgcgcggguucgccgcccuggagccccucgucgaccugcccaucggcaucaacaucacccgguuccagacgcugcucgcccugcaccgcagcuaccugacccccggcaagcucgaguccggguggaccaccggcgcggccgccuacuacgugggguaccugcagcagcggacguuccugcucagcuacaaccagaacggcaccaucaccgacgccguggacugcucccuggacccgcugagcgagaccaagugcacgcucaagucccugaccgucgagaagggcaucuaccagaccagcaacuuccgcgugcagcccaccaucagcaucgugcgguuccccaacaucacgaaccugugccccuucggggaggucuucaacgcguccaaguucgccagcguguacgccuggaaccgcaagcggaucuccaacugcgucgccgacuacagcgugcucuacaacuccaccagcuucuccaccuucaagugcuacggcgugagcccgaccaagcugaacgaccugugcuucacgaacgucuacgccgacuccuucguggugaagggggacgagguccgccagaucgcgcccggccagaccggggugaucgccgacuacaacuacaagcuccccgacgacuucaccggcugcgugaucgccuggaacagcgucaagcaggacgcccugaccggcgggaacuaccuguaccgccucuuccggaaguccaagcugaagcccuucgagcgggacaucagcacggagaucuaccaggccggcuccaccccgugcaacggccagguggggcugaacugcuacuacccccucgagcgcuacggguuccaccccaccaccggcgugaacuaccagcccuuccgggucguggugcugagcuucgagcugcucaacggcccggcgaccgucugcgggcccaagcuguccacgacccuggugaaggacaagugcgugaacuucaacuucaacggccugaccgggaccggcguccucacgaccagcaagaagcaguuccugcccuuccagcaguucgggcgcgacaucuccgacaccaccgacgccgugcgcgacccccagacgcuggagauccucgacaucaccccgugcagcuucggcggcguguccgucaucacccccgggaccaacacgagcaaccagguggccgugcuguaccaggacgucaacugcaccgaggugcccauggccauccacgccgagcagcugaccccggcguggcggguguacagcgccggcgccaacgucuuccagacccgcgccgggugccucgugggcgccgagcacgugaacaacuccuacgagugcgacauccccgucggcgcggggaucugcgccagcuaccacuccaugagcucccugcggagcgugaaccagcgcuccaucaucgccuacacgaugagccugggcgccgagaacuccguggcguacagcaacaacuccaucgccauccccaccaacuucaccaucagcgucaccacggagauccuccccguguccaugaccaagaccagcguggacugcaccauguacaucugcggggacuccaucgagugcagcaaccugcugcuccaguacggcuccuucugcacgcagcugaaccgggcccugaccgggaucgccgucgagcaggacaagaacacccaggagguguucgcccaggugaagcagaucuacaagaccccgcccaucaaggacuucggcggcuucaacuucagccagauccuccccgaccccagcaagccguccaagcgcagcuucaucgaggaccugcuguucaacaaggucacgcucgcggacgccggguucaucaagcaguacggcgacugccugggggacaucgccgcccgggaccugaucugcgcccagaaguucaacggccucaccgugcugccgccccugcucaccgacgagaugaucgcgcaguacaccuccgcccugcuggccgggacgaucaccagcggcuggaccuucggcgccggggccgcgcuccagauccccuucgccaugcagauggccuaccgcuucaacggcaucggggugacccagaacguccuguacgagaaccagaagcugaucgccaaccaguucaacuccgcgaucggcaagauccaggacagccucuccagcacggccuccgcccuggggaagcugcaggacguggugaaccagaacgcccaggcccucaacacccuggucaagcagcugagcuccaacuucggcgcgaucagcuccgugcucaacgacauccugagccggcuggacaagguggaggccgagguccagaucgaccgccucaucaccggccggcugcagucccugcagaccuacgugacccagcagcucauccgcgccgccgagauccgggccagcgcgaaccuggccgccacgaagauguccgagugcgugcuggggcagagcaagcgcgucgacuucugcggcaagggguaccaccucauguccuucccccagagcgcgccccacggcguggucuuccugcacgugaccuacgugcccgcccaggagaagaacuucaccaccgcccccgccaucugccacgaggggaaggcccacuucccgcgggagggcgucuucgugagcaacggcacgcacugguucaucacccagcgcaacuucuacgagccccagaucaucaccaccgacaacacguucguguccgggagcugcgacgucgugaucggcaucgugaacaacaccgucuacgacccccugcagcccgagcucgacuccuucaaggaggagcuggacaaguacuucaagaaccacaccagcccggacguggaccugggggacaucuccggcaucaacgccagcguggucaacauccagaaggagaucgaccggcucaacgagguggcgaagaaccugaacgagucccugaucgaccuccaggagcugggcaaguacgagcaguacaucaaguggcccugguacaucuggcugggguucaucgccggccucaucgccaucaucauggugaccaucaugcugugcugcaugacgagcugcugcuccugccugaaggggugcugcagcugcggcuccugcugcaaguucgacgaggacgacagcgagcccguccucaagggggugaagcugcacuacaccuga

SEQ ID NO: 11798 - RNA, 3822 nt, Artificial Sequence; identical to SEQ ID NO: 137
  SARS-CoV-2/Wuhan/WIV05/2019__EPI_ISL_402128 spike protein CDS gc (1-1273)(K986P_V987P)

SEQ ID NO: 11799 - RNA, 3822 nt, Artificial Sequence
  SARS-CoV-2/Wuhan/WIV05/2019__EPI_ISL_402128 spike protein CDS gc (1-1273)(K986P_V987P_T887WN_A1020W)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11800 - RNA, 3822 nt, Artificial Sequence
  SARS-CoV-2/Wuhan/WIV05/2019__EPI_ISL_402128 spike protein CDS gc (1-1273)(K986P_V987P_P1069F)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11801 - RNA, 3822 nt, Artificial Sequence
  SARS-CoV-2/Wuhan/WIV05/2019__EPI_ISL_402128 spike protein CDS gc (1-1273)(K986P_V987P_ H1048Q_H1064N_ H1083N_H1101N)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11802 - RNA, 3822 nt, Artificial Sequence
  SARS-CoV-2/Wuhan/WIV05/2019__EPI_ISL_402128 spike protein CDS gc (1-1273)(I712C_T1077C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11803 - RNA, 3822 nt, Artificial Sequence
  SARS-CoV-2/Wuhan/WIV05/2019__EPI_ISL_402128 spike protein CDS gc (1-1273)(I714C_Y1110C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11804 - RNA, 3822 nt, Artificial Sequence
  SARS-CoV-2/Wuhan/WIV05/2019__EPI_ISL_402128 spike protein CDS gc (1-1273)(P715C_P1069C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11805 - RNA, 3822 nt, Artificial Sequence
  SARS-CoV-2/Wuhan/WIV05/2019__EPI_ISL_402128 spike protein CDS gc (1-1273)(G889C_L1034C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11806 - RNA, 3822 nt, Artificial Sequence
  SARS-CoV-2/Wuhan/WIV05/2019__EPI_ISL_402128 spike protein CDS gc (1-1273)(I909C_Y1047C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11807 - RNA, 3822 nt, Artificial Sequence
  SARS-CoV-2/Wuhan/WIV05/2019__EPI_ISL_402128 spike protein CDS gc (1-1273)(Q965C_S1003C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11808 - RNA, 3822 nt, Artificial Sequence
  SARS-CoV-2/Wuhan/WIV05/2019__EPI_ISL_402128 spike protein CDS gc (1-1273)(F970C_G999C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11809 - RNA, 3822 nt, Artificial Sequence
  SARS-CoV-2/Wuhan/WIV05/2019__EPI_ISL_402128 spike protein CDS gc (1-1273)(A972C_R995C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11810 - RNA, 3822 nt, Artificial Sequence
  SARS-CoV-2/Wuhan/WIV05/2019__EPI_ISL_402128 spike protein CDS gc (1-1273)(A890C_V1040C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11811 - RNA, 3822 nt, Artificial Sequence
  SARS-CoV-2/Wuhan/WIV05/2019__EPI_ISL_402128 spike protein CDS gc (1-1273)(T874C_S1055C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11812 - RNA, 2046 nt, Artificial Sequence; identical to SEQ ID NO: 138
  SARS-CoV-2/Wuhan/WIV05/2019__EPI_ISL_402128 spike protein CDS gc (1-681)

SEQ ID NO: 11813 - RNA, 1776 nt, Artificial Sequence; identical to SEQ ID NO: 141
  SARS-CoV-2/Wuhan/WIV05/2019__EPI_ISL_402128 spike protein CDS gc (682-1273)

SEQ ID NO: 11814 - RNA, 45 nt, Artificial Sequence; identical to SEQ ID NO: 139
  SARS-CoV-2/Wuhan/WIV05/2019__EPI_ISL_402128 spike protein CDS gc (1-15)

SEQ ID NO: 11815 - RNA, 1998 nt, Artificial Sequence; identical to SEQ ID NO: 140
  SARS-CoV-2/Wuhan/WIV05/2019__EPI_ISL_402128 spike protein CDS gc (16-681)

SEQ ID NO: 11816 - RNA, 189 nt, Artificial Sequence
  SARS-CoV-2/Wuhan/WIV05/2019__EPI_ISL_402128 spike protein CDS gc (1212-1273)
uggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacguga

SEQ ID NO: 11817 - RNA, 3633 nt, Artificial Sequence
  SARS-CoV-2/Wuhan/WIV05/2019__EPI_ISL_402128 spike protein CDS gc (1-1211)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11818 - RNA, 3633 nt, Artificial Sequence
  SARS-CoV-2/Wuhan/WIV05/2019__EPI_ISL_402128 spike protein CDS gc (1-1211)(K986P_V987P)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11819 - RNA, 3633 nt, Artificial Sequence
  SARS-CoV-2/Wuhan/WIV05/2019__EPI_ISL_402128 spike protein CDS gc (1-1211)(K986P_V987P_T887WN_A1020W)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11820 - RNA, 3633 nt, Artificial Sequence
  SARS-CoV-2/Wuhan/WIV05/2019__EPI_ISL_402128 spike protein CDS gc (1-1211)(K986P_V987P_P1069F)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11821 - RNA, 3633 nt, Artificial Sequence
  SARS-CoV-2/Wuhan/WIV05/2019__EPI_ISL_402128 spike protein CDS gc (1-1211)(K986P_V987P_ H1048Q_H1064N_ H1083N_H1101N)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11822 - RNA, 3633 nt, Artificial Sequence
  SARS-CoV-2/Wuhan/WIV05/2019__EPI_ISL_402128 spike protein CDS gc (1-1211)(I712C_T1077C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11823 - RNA, 3633 nt, Artificial Sequence
  SARS-CoV-2/Wuhan/WIV05/2019__EPI_ISL_402128 spike protein CDS gc (1-1211)(I714C_Y1110C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11824 - RNA, 3633 nt, Artificial Sequence
  SARS-CoV-2/Wuhan/WIV05/2019__EPI_ISL_402128 spike protein CDS gc (1-1211)(P715C_P1069C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11825 - RNA, 3633 nt, Artificial Sequence
  SARS-CoV-2/Wuhan/WIV05/2019__EPI_ISL_402128 spike protein CDS gc (1-1211)(G889C_L1034C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11826 - RNA, 3633 nt, Artificial Sequence
  SARS-CoV-2/Wuhan/WIV05/2019__EPI_ISL_402128 spike protein CDS gc (1-1211)(I909C_Y1047C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11827 - RNA, 3633 nt, Artificial Sequence
  SARS-CoV-2/Wuhan/WIV05/2019__EPI_ISL_402128 spike protein CDS gc (1-1211)(Q965C_S1003C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11828 - RNA, 3633 nt, Artificial Sequence
  SARS-CoV-2/Wuhan/WIV05/2019__EPI_ISL_402128 spike protein CDS gc (1-1211)(F970C_G999C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11829 - RNA, 3633 nt, Artificial Sequence
  SARS-CoV-2/Wuhan/WIV05/2019__EPI_ISL_402128 spike protein CDS gc (1-1211)(A972C_R995C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11830 - RNA, 3633 nt, Artificial Sequence
  SARS-CoV-2/Wuhan/WIV05/2019__EPI_ISL_402128 spike protein CDS gc (1-1211)(A890C_V1040C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11831 - RNA, 3633 nt, Artificial Sequence
  SARS-CoV-2/Wuhan/WIV05/2019__EPI_ISL_402128 spike protein CDS gc (1-1211)(T874C_S1055C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaag

SEQ ID NO: 11832 - RNA, 3441 nt, Artificial Sequence
  SARS-CoV-2/Wuhan/WIV05/2019__EPI_ISL_402128 spike protein CDS gc (1-1147)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11833 - RNA, 3441 nt, Artificial Sequence
  SARS-CoV-2/Wuhan/WIV05/2019__EPI_ISL_402128 spike protein CDS gc (1-1147)(K986P_V987P)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11834 - RNA, 3441 nt, Artificial Sequence
  SARS-CoV-2/Wuhan/WIV05/2019__EPI_ISL_402128 spike protein CDS gc (1-1147)(K986P_V987P_T887WN_A1020W)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11835 - RNA, 3441 nt, Artificial Sequence
  SARS-CoV-2/Wuhan/WIV05/2019__EPI_ISL_402128 spike protein CDS gc (1-1147)(K986P_V987P_P1069F)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11836 - RNA, 3441 nt, Artificial Sequence
  SARS-CoV-2/Wuhan/WIV05/2019__EPI_ISL_402128 spike protein CDS gc (1-1147)(K986P_V987P_ H1048Q_H1064N_ H1083N_H1101N)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11837 - RNA, 3441 nt, Artificial Sequence
  SARS-CoV-2/Wuhan/WIV05/2019__EPI_ISL_402128 spike protein CDS gc (1-1147)(I712C_T1077C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11838 - RNA, 3441 nt, Artificial Sequence
  SARS-CoV-2/Wuhan/WIV05/2019__EPI_ISL_402128 spike protein CDS gc (1-1147)(I714C_Y1110C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacucc

SEQ ID NO: 11839 - RNA, 3441 nt, Artificial Sequence
  SARS-CoV-2/Wuhan/WIV05/2019__EPI_ISL_402128 spike protein CDS gc (1-1147)(P715C_P1069C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11840 - RNA, 3441 nt, Artificial Sequence
  SARS-CoV-2/Wuhan/WIV05/2019__EPI_ISL_402128 spike protein CDS gc (1-1147)(G889C_L1034C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11841 - RNA, 3441 nt, Artificial Sequence
  SARS-CoV-2/Wuhan/WIV05/2019__EPI_ISL_402128 spike protein CDS gc (1-1147)(I909C_Y1047C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11842 - RNA, 3441 nt, Artificial Sequence
  SARS-CoV-2/Wuhan/WIV05/2019__EPI_ISL_402128 spike protein CDS gc (1-1147)(Q965C_S1003C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11843 - RNA, 3441 nt, Artificial Sequence
  SARS-CoV-2/Wuhan/WIV05/2019__EPI_ISL_402128 spike protein CDS gc (1-1147)(F970C_G999C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11844 - RNA, 3441 nt, Artificial Sequence
  SARS-CoV-2/Wuhan/WIV05/2019__EPI_ISL_402128 spike protein CDS gc (1-1147)(A972C_R995C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11845 - RNA, 3441 nt, Artificial Sequence
  SARS-CoV-2/Wuhan/WIV05/2019__EPI_ISL_402128 spike protein CDS gc (1-1147)(A890C_V1040C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11846 - RNA, 3441 nt, Artificial Sequence
  SARS-CoV-2/Wuhan/WIV05/2019__EPI_ISL_402128 spike protein CDS gc (1-1147)(T874C_S1055C)
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacucc

SEQ ID NO: 11847 - RNA, 4116 nt, Artificial Sequence
  SARS-CoV-2/Wuhan/WIV05/2019__EPI_ISL_402128 spike protein CDS gc (1-1211) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11848 - RNA, 4116 nt, Artificial Sequence
  SARS-CoV-2/Wuhan/WIV05/2019__EPI_ISL_402128 spike protein CDS gc (1-1211)(K986P_V987P) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11849 - RNA, 4116 nt, Artificial Sequence
  SARS-CoV-2/Wuhan/WIV05/2019__EPI_ISL_402128 spike protein CDS gc (1-1211)(K986P_V987P_T887WN_A1020W) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11850 - RNA, 4116 nt, Artificial Sequence
  SARS-CoV-2/Wuhan/WIV05/2019__EPI_ISL_402128 spike protein CDS gc (1-1211)(K986P_V987P_P1069F) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11851 - RNA, 4116 nt, Artificial Sequence
  SARS-CoV-2/Wuhan/WIV05/2019__EPI_ISL_402128 spike protein CDS gc (1-1211)(K986P_V987P_ H1048Q_H1064N_ H1083N_H1101N) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11852 - RNA, 4116 nt, Artificial Sequence
  SARS-CoV-2/Wuhan/WIV05/2019__EPI_ISL_402128 spike protein CDS gc (1-1211)(I712C_T1077C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11853 - RNA, 4116 nt, Artificial Sequence
  SARS-CoV-2/Wuhan/WIV05/2019__EPI_ISL_402128 spike protein CDS gc (1-1211)(I714C_Y1110C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11854 - RNA, 4116 nt, Artificial Sequence
  SARS-CoV-2/Wuhan/WIV05/2019__EPI_ISL_402128 spike protein CDS gc (1-1211)(P715C_P1069C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11855 - RNA, 4116 nt, Artificial Sequence
  SARS-CoV-2/Wuhan/WIV05/2019__EPI_ISL_402128 spike protein CDS gc (1-1211)(G889C_L1034C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11856 - RNA, 4116 nt, Artificial Sequence
  SARS-CoV-2/Wuhan/WIV05/2019__EPI_ISL_402128 spike protein CDS gc (1-1211)(I909C_Y1047C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11857 - RNA, 4116 nt, Artificial Sequence
  SARS-CoV-2/Wuhan/WIV05/2019__EPI_ISL_402128 spike protein CDS gc (1-1211)(Q965C_S1003C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11858 - RNA, 4116 nt, Artificial Sequence
  SARS-CoV-2/Wuhan/WIV05/2019__EPI_ISL_402128 spike protein CDS gc (1-1211)(F970C_G999C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11859 - RNA, 4116 nt, Artificial Sequence
  SARS-CoV-2/Wuhan/WIV05/2019__EPI_ISL_402128 spike protein CDS gc (1-1211)(A972C_R995C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11860 - RNA, 4116 nt, Artificial Sequence
  SARS-CoV-2/Wuhan/WIV05/2019__EPI_ISL_402128 spike protein CDS gc (1-1211)(A890C_V1040C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11861 - RNA, 4116 nt, Artificial Sequence
  SARS-CoV-2/Wuhan/WIV05/2019__EPI_ISL_402128 spike protein CDS gc (1-1211)(T874C_S1055C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11862 - RNA, 4140 nt, Artificial Sequence
  SARS-CoV-2/Wuhan/WIV05/2019__EPI_ISL_402128 spike protein CDS gc (1-1211) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11863 - RNA, 4140 nt, Artificial Sequence
  SARS-CoV-2/Wuhan/WIV05/2019__EPI_ISL_402128 spike protein CDS gc (1-1211)(K986P_V987P) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11864 - RNA, 4140 nt, Artificial Sequence
  SARS-CoV-2/Wuhan/WIV05/2019__EPI_ISL_402128 spike protein CDS gc (1-1211)(K986P_V987P_T887WN_A1020W) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11865 - RNA, 4140 nt, Artificial Sequence
  SARS-CoV-2/Wuhan/WIV05/2019__EPI_ISL_402128 spike protein CDS gc (1-1211)(K986P_V987P_P1069F) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11866 - RNA, 4140 nt, Artificial Sequence
  SARS-CoV-2/Wuhan/WIV05/2019__EPI_ISL_402128 spike protein CDS gc (1-1211)(K986P_V987P_ H1048Q_H1064N_ H1083N_H1101N) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11867 - RNA, 4140 nt, Artificial Sequence
  SARS-CoV-2/Wuhan/WIV05/2019__EPI_ISL_402128 spike protein CDS gc (1-1211)(I712C_T1077C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11868 - RNA, 4140 nt, Artificial Sequence
  SARS-CoV-2/Wuhan/WIV05/2019__EPI_ISL_402128 spike protein CDS gc (1-1211)(I714C_Y1110C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11869 - RNA, 4140 nt, Artificial Sequence
  SARS-CoV-2/Wuhan/WIV05/2019__EPI_ISL_402128 spike protein CDS gc (1-1211)(P715C_P1069C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11870 - RNA, 4140 nt, Artificial Sequence
  SARS-CoV-2/Wuhan/WIV05/2019__EPI_ISL_402128 spike protein CDS gc (1-1211)(G889C_L1034C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11871 - RNA, 4140 nt, Artificial Sequence
  SARS-CoV-2/Wuhan/WIV05/2019__EPI_ISL_402128 spike protein CDS gc (1-1211)(I909C_Y1047C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11872 - RNA, 4140 nt, Artificial Sequence
  SARS-CoV-2/Wuhan/WIV05/2019__EPI_ISL_402128 spike protein CDS gc (1-1211)(Q965C_S1003C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11873 - RNA, 4140 nt, Artificial Sequence
  SARS-CoV-2/Wuhan/WIV05/2019__EPI_ISL_402128 spike protein CDS gc (1-1211)(F970C_G999C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11874 - RNA, 4140 nt, Artificial Sequence
  SARS-CoV-2/Wuhan/WIV05/2019__EPI_ISL_402128 spike protein CDS gc (1-1211)(A972C_R995C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11875 - RNA, 4140 nt, Artificial Sequence
  SARS-CoV-2/Wuhan/WIV05/2019__EPI_ISL_402128 spike protein CDS gc (1-1211)(A890C_V1040C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11876 - RNA, 4140 nt, Artificial Sequence
  SARS-CoV-2/Wuhan/WIV05/2019__EPI_ISL_402128 spike protein CDS gc (1-1211)(T874C_S1055C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11877 - RNA, 3726 nt, Artificial Sequence
  SARS-CoV-2/Wuhan/WIV05/2019__EPI_ISL_402128 spike protein CDS gc (1-1211) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11878 - RNA, 3726 nt, Artificial Sequence
  SARS-CoV-2/Wuhan/WIV05/2019__EPI_ISL_402128 spike protein CDS gc (1-1211)(K986P_V987P) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11879 - RNA, 3726 nt, Artificial Sequence
  SARS-CoV-2/Wuhan/WIV05/2019__EPI_ISL_402128 spike protein CDS gc (1-1211)(K986P_V987P_T887WN_A1020W) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11880 - RNA, 3726 nt, Artificial Sequence
  SARS-CoV-2/Wuhan/WIV05/2019__EPI_ISL_402128 spike protein CDS gc (1-1211)(K986P_V987P_P1069F) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11881 - RNA, 3726 nt, Artificial Sequence
  SARS-CoV-2/Wuhan/WIV05/2019__EPI_ISL_402128 spike protein CDS gc (1-1211)(K986P_V987P_ H1048Q_H1064N_ H1083N_H1101N) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11882 - RNA, 3726 nt, Artificial Sequence
  SARS-CoV-2/Wuhan/WIV05/2019__EPI_ISL_402128 spike protein CDS gc (1-1211)(I712C_T1077C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11883 - RNA, 3726 nt, Artificial Sequence
  SARS-CoV-2/Wuhan/WIV05/2019__EPI_ISL_402128 spike protein CDS gc (1-1211)(I714C_Y1110C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11884 - RNA, 3726 nt, Artificial Sequence
  SARS-CoV-2/Wuhan/WIV05/2019__EPI_ISL_402128 spike protein CDS gc (1-1211)(P715C_P1069C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11885 - RNA, 3726 nt, Artificial Sequence
  SARS-CoV-2/Wuhan/WIV05/2019__EPI_ISL_402128 spike protein CDS gc (1-1211)(G889C_L1034C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11886 - RNA, 3726 nt, Artificial Sequence
  SARS-CoV-2/Wuhan/WIV05/2019__EPI_ISL_402128 spike protein CDS gc (1-1211)(I909C_Y1047C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11887 - RNA, 3726 nt, Artificial Sequence
  SARS-CoV-2/Wuhan/WIV05/2019__EPI_ISL_402128 spike protein CDS gc (1-1211)(Q965C_S1003C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11888 - RNA, 3726 nt, Artificial Sequence
  SARS-CoV-2/Wuhan/WIV05/2019__EPI_ISL_402128 spike protein CDS gc (1-1211)(F970C_G999C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11889 - RNA, 3726 nt, Artificial Sequence
  SARS-CoV-2/Wuhan/WIV05/2019__EPI_ISL_402128 spike protein CDS gc (1-1211)(A972C_R995C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11890 - RNA, 3726 nt, Artificial Sequence
  SARS-CoV-2/Wuhan/WIV05/2019__EPI_ISL_402128 spike protein CDS gc (1-1211)(A890C_V1040C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11891 - RNA, 3726 nt, Artificial Sequence
  SARS-CoV-2/Wuhan/WIV05/2019__EPI_ISL_402128 spike protein CDS gc (1-1211)(T874C_S1055C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccuguga

SEQ ID NO: 11892 - RNA, 4098 nt, Artificial Sequence
  SARS-CoV-2/Wuhan/WIV05/2019__EPI_ISL_402128 spike protein CDS gc (1-1211) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11893 - RNA, 4098 nt, Artificial Sequence
  SARS-CoV-2/Wuhan/WIV05/2019__EPI_ISL_402128 spike protein CDS gc (1-1211)(K986P_V987P) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11894 - RNA, 4098 nt, Artificial Sequence
  SARS-CoV-2/Wuhan/WIV05/2019__EPI_ISL_402128 spike protein CDS gc (1-1211)(K986P_V987P_T887WN_A1020W) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11895 - RNA, 4098 nt, Artificial Sequence
  SARS-CoV-2/Wuhan/WIV05/2019__EPI_ISL_402128 spike protein CDS gc (1-1211)(K986P_V987P_P1069F) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11896 - RNA, 4098 nt, Artificial Sequence
  SARS-CoV-2/Wuhan/WIV05/2019__EPI_ISL_402128 spike protein CDS gc (1-1211)(K986P_V987P_ H1048Q_H1064N_ H1083N_H1101N) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11897 - RNA, 4098 nt, Artificial Sequence
  SARS-CoV-2/Wuhan/WIV05/2019__EPI_ISL_402128 spike protein CDS gc (1-1211)(I712C_T1077C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11898 - RNA, 4098 nt, Artificial Sequence
  SARS-CoV-2/Wuhan/WIV05/2019__EPI_ISL_402128 spike protein CDS gc (1-1211)(I714C_Y1110C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11899 - RNA, 4098 nt, Artificial Sequence
  SARS-CoV-2/Wuhan/WIV05/2019__EPI_ISL_402128 spike protein CDS gc (1-1211)(P715C_P1069C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11900 - RNA, 4098 nt, Artificial Sequence
  SARS-CoV-2/Wuhan/WIV05/2019__EPI_ISL_402128 spike protein CDS gc (1-1211)(G889C_L1034C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11901 - RNA, 4098 nt, Artificial Sequence
  SARS-CoV-2/Wuhan/WIV05/2019__EPI_ISL_402128 spike protein CDS gc (1-1211)(I909C_Y1047C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11902 - RNA, 4098 nt, Artificial Sequence
  SARS-CoV-2/Wuhan/WIV05/2019__EPI_ISL_402128 spike protein CDS gc (1-1211)(Q965C_S1003C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11903 - RNA, 4098 nt, Artificial Sequence
  SARS-CoV-2/Wuhan/WIV05/2019__EPI_ISL_402128 spike protein CDS gc (1-1211)(F970C_G999C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11904 - RNA, 4098 nt, Artificial Sequence
  SARS-CoV-2/Wuhan/WIV05/2019__EPI_ISL_402128 spike protein CDS gc (1-1211)(A972C_R995C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11905 - RNA, 4098 nt, Artificial Sequence
  SARS-CoV-2/Wuhan/WIV05/2019__EPI_ISL_402128 spike protein CDS gc (1-1211)(A890C_V1040C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11906 - RNA, 4098 nt, Artificial Sequence
  SARS-CoV-2/Wuhan/WIV05/2019__EPI_ISL_402128 spike protein CDS gc (1-1211)(T874C_S1055C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11907 - RNA, 3924 nt, Artificial Sequence
  SARS-CoV-2/Wuhan/WIV05/2019__EPI_ISL_402128 spike protein CDS gc (1-1147) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11908 - RNA, 3924 nt, Artificial Sequence
  SARS-CoV-2/Wuhan/WIV05/2019__EPI_ISL_402128 spike protein CDS gc (1-1147)(K986P_V987P) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11909 - RNA, 3924 nt, Artificial Sequence
  SARS-CoV-2/Wuhan/WIV05/2019__EPI_ISL_402128 spike protein CDS gc (1-1147)(K986P_V987P_T887WN_A1020W) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11910 - RNA, 3924 nt, Artificial Sequence
  SARS-CoV-2/Wuhan/WIV05/2019__EPI_ISL_402128 spike protein CDS gc (1-1147)(K986P_V987P_P1069F) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11911 - RNA, 3924 nt, Artificial Sequence
  SARS-CoV-2/Wuhan/WIV05/2019__EPI_ISL_402128 spike protein CDS gc (1-1147)(K986P_V987P_ H1048Q_H1064N_ H1083N_H1101N) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11912 - RNA, 3924 nt, Artificial Sequence
  SARS-CoV-2/Wuhan/WIV05/2019__EPI_ISL_402128 spike protein CDS gc (1-1147)(I712C_T1077C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11913 - RNA, 3924 nt, Artificial Sequence
  SARS-CoV-2/Wuhan/WIV05/2019__EPI_ISL_402128 spike protein CDS gc (1-1147)(I714C_Y1110C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11914 - RNA, 3924 nt, Artificial Sequence
  SARS-CoV-2/Wuhan/WIV05/2019__EPI_ISL_402128 spike protein CDS gc (1-1147)(P715C_P1069C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11915 - RNA, 3924 nt, Artificial Sequence
  SARS-CoV-2/Wuhan/WIV05/2019__EPI_ISL_402128 spike protein CDS gc (1-1147)(G889C_L1034C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11916 - RNA, 3924 nt, Artificial Sequence
  SARS-CoV-2/Wuhan/WIV05/2019__EPI_ISL_402128 spike protein CDS gc (1-1147)(I909C_Y1047C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11917 - RNA, 3924 nt, Artificial Sequence
  SARS-CoV-2/Wuhan/WIV05/2019__EPI_ISL_402128 spike protein CDS gc (1-1147)(Q965C_S1003C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11918 - RNA, 3924 nt, Artificial Sequence
  SARS-CoV-2/Wuhan/WIV05/2019__EPI_ISL_402128 spike protein CDS gc (1-1147)(F970C_G999C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11919 - RNA, 3924 nt, Artificial Sequence
  SARS-CoV-2/Wuhan/WIV05/2019__EPI_ISL_402128 spike protein CDS gc (1-1147)(A972C_R995C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11920 - RNA, 3924 nt, Artificial Sequence
  SARS-CoV-2/Wuhan/WIV05/2019__EPI_ISL_402128 spike protein CDS gc (1-1147)(A890C_V1040C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11921 - RNA, 3924 nt, Artificial Sequence
  SARS-CoV-2/Wuhan/WIV05/2019__EPI_ISL_402128 spike protein CDS gc (1-1147)(T874C_S1055C) LumSynth construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcuga

SEQ ID NO: 11922 - RNA, 3948 nt, Artificial Sequence
  SARS-CoV-2/Wuhan/WIV05/2019__EPI_ISL_402128 spike protein CDS gc (1-1147) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11923 - RNA, 3948 nt, Artificial Sequence
  SARS-CoV-2/Wuhan/WIV05/2019__EPI_ISL_402128 spike protein CDS gc (1-1147)(K986P_V987P) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11924 - RNA, 3948 nt, Artificial Sequence
  SARS-CoV-2/Wuhan/WIV05/2019__EPI_ISL_402128 spike protein CDS gc (1-1147)(K986P_V987P_T887WN_A1020W) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11925 - RNA, 3948 nt, Artificial Sequence
  SARS-CoV-2/Wuhan/WIV05/2019__EPI_ISL_402128 spike protein CDS gc (1-1147)(K986P_V987P_P1069F) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11926 - RNA, 3948 nt, Artificial Sequence
  SARS-CoV-2/Wuhan/WIV05/2019__EPI_ISL_402128 spike protein CDS gc (1-1147)(K986P_V987P_ H1048Q_H1064N_ H1083N_H1101N) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11927 - RNA, 3948 nt, Artificial Sequence
  SARS-CoV-2/Wuhan/WIV05/2019__EPI_ISL_402128 spike protein CDS gc (1-1147)(I712C_T1077C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11928 - RNA, 3948 nt, Artificial Sequence
  SARS-CoV-2/Wuhan/WIV05/2019__EPI_ISL_402128 spike protein CDS gc (1-1147)(I714C_Y1110C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11929 - RNA, 3948 nt, Artificial Sequence
  SARS-CoV-2/Wuhan/WIV05/2019__EPI_ISL_402128 spike protein CDS gc (1-1147)(P715C_P1069C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11930 - RNA, 3948 nt, Artificial Sequence
  SARS-CoV-2/Wuhan/WIV05/2019__EPI_ISL_402128 spike protein CDS gc (1-1147)(G889C_L1034C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11931 - RNA, 3948 nt, Artificial Sequence
  SARS-CoV-2/Wuhan/WIV05/2019__EPI_ISL_402128 spike protein CDS gc (1-1147)(I909C_Y1047C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11932 - RNA, 3948 nt, Artificial Sequence
  SARS-CoV-2/Wuhan/WIV05/2019__EPI_ISL_402128 spike protein CDS gc (1-1147)(Q965C_S1003C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11933 - RNA, 3948 nt, Artificial Sequence
  SARS-CoV-2/Wuhan/WIV05/2019__EPI_ISL_402128 spike protein CDS gc (1-1147)(F970C_G999C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11934 - RNA, 3948 nt, Artificial Sequence
  SARS-CoV-2/Wuhan/WIV05/2019__EPI_ISL_402128 spike protein CDS gc (1-1147)(A972C_R995C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11935 - RNA, 3948 nt, Artificial Sequence
  SARS-CoV-2/Wuhan/WIV05/2019__EPI_ISL_402128 spike protein CDS gc (1-1147)(A890C_V1040C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11936 - RNA, 3948 nt, Artificial Sequence
  SARS-CoV-2/Wuhan/WIV05/2019__EPI_ISL_402128 spike protein CDS gc (1-1147)(T874C_S1055C) Ferritin construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccuga

SEQ ID NO: 11937 - RNA, 3534 nt, Artificial Sequence
  SARS-CoV-2/Wuhan/WIV05/2019__EPI_ISL_402128 spike protein CDS gc (1-1147) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11938 - RNA, 3534 nt, Artificial Sequence
  SARS-CoV-2/Wuhan/WIV05/2019__EPI_ISL_402128 spike protein CDS gc (1-1147)(K986P_V987P) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11939 - RNA, 3534 nt, Artificial Sequence
  SARS-CoV-2/Wuhan/WIV05/2019__EPI_ISL_402128 spike protein CDS gc (1-1147)(K986P_V987P_T887WN_A1020W) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11940 - RNA, 3534 nt, Artificial Sequence
  SARS-CoV-2/Wuhan/WIV05/2019__EPI_ISL_402128 spike protein CDS gc (1-1147)(K986P_V987P_P1069F) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11941 - RNA, 3534 nt, Artificial Sequence
  SARS-CoV-2/Wuhan/WIV05/2019__EPI_ISL_402128 spike protein CDS gc (1-1147)(K986P_V987P_ H1048Q_H1064N_ H1083N_H1101N) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11942 - RNA, 3534 nt, Artificial Sequence
  SARS-CoV-2/Wuhan/WIV05/2019__EPI_ISL_402128 spike protein CDS gc (1-1147)(I712C_T1077C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11943 - RNA, 3534 nt, Artificial Sequence
  SARS-CoV-2/Wuhan/WIV05/2019__EPI_ISL_402128 spike protein CDS gc (1-1147)(I714C_Y1110C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11944 - RNA, 3534 nt, Artificial Sequence
  SARS-CoV-2/Wuhan/WIV05/2019__EPI_ISL_402128 spike protein CDS gc (1-1147)(P715C_P1069C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11945 - RNA, 3534 nt, Artificial Sequence
  SARS-CoV-2/Wuhan/WIV05/2019__EPI_ISL_402128 spike protein CDS gc (1-1147)(G889C_L1034C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11946 - RNA, 3534 nt, Artificial Sequence
  SARS-CoV-2/Wuhan/WIV05/2019__EPI_ISL_402128 spike protein CDS gc (1-1147)(I909C_Y1047C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11947 - RNA, 3534 nt, Artificial Sequence
  SARS-CoV-2/Wuhan/WIV05/2019__EPI_ISL_402128 spike protein CDS gc (1-1147)(Q965C_S1003C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11948 - RNA, 3534 nt, Artificial Sequence
  SARS-CoV-2/Wuhan/WIV05/2019__EPI_ISL_402128 spike protein CDS gc (1-1147)(F970C_G999C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11949 - RNA, 3534 nt, Artificial Sequence
  SARS-CoV-2/Wuhan/WIV05/2019__EPI_ISL_402128 spike protein CDS gc (1-1147)(A972C_R995C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11950 - RNA, 3534 nt, Artificial Sequence
  SARS-CoV-2/Wuhan/WIV05/2019__EPI_ISL_402128 spike protein CDS gc (1-1147)(A890C_V1040C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11951 - RNA, 3534 nt, Artificial Sequence
  SARS-CoV-2/Wuhan/WIV05/2019__EPI_ISL_402128 spike protein CDS gc (1-1147)(T874C_S1055C) Foldon construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccuguga

SEQ ID NO: 11952 - RNA, 3906 nt, Artificial Sequence
  SARS-CoV-2/Wuhan/WIV05/2019__EPI_ISL_402128 spike protein CDS gc (1-1147) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11953 - RNA, 3906 nt, Artificial Sequence
  SARS-CoV-2/Wuhan/WIV05/2019__EPI_ISL_402128 spike protein CDS gc (1-1147)(K986P_V987P) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11954 - RNA, 3906 nt, Artificial Sequence
  SARS-CoV-2/Wuhan/WIV05/2019__EPI_ISL_402128 spike protein CDS gc (1-1147)(K986P_V987P_T887WN_A1020W) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11955 - RNA, 3906 nt, Artificial Sequence
  SARS-CoV-2/Wuhan/WIV05/2019__EPI_ISL_402128 spike protein CDS gc (1-1147)(K986P_V987P_P1069F) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11956 - RNA, 3906 nt, Artificial Sequence
  SARS-CoV-2/Wuhan/WIV05/2019__EPI_ISL_402128 spike protein CDS gc (1-1147)(K986P_V987P_ H1048Q_H1064N_ H1083N_H1101N) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11957 - RNA, 3906 nt, Artificial Sequence
  SARS-CoV-2/Wuhan/WIV05/2019__EPI_ISL_402128 spike protein CDS gc (1-1147)(I712C_T1077C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11958 - RNA, 3906 nt, Artificial Sequence
  SARS-CoV-2/Wuhan/WIV05/2019__EPI_ISL_402128 spike protein CDS gc (1-1147)(I714C_Y1110C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11959 - RNA, 3906 nt, Artificial Sequence
  SARS-CoV-2/Wuhan/WIV05/2019__EPI_ISL_402128 spike protein CDS gc (1-1147)(P715C_P1069C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11960 - RNA, 3906 nt, Artificial Sequence
  SARS-CoV-2/Wuhan/WIV05/2019__EPI_ISL_402128 spike protein CDS gc (1-1147)(G889C_L1034C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11961 - RNA, 3906 nt, Artificial Sequence
  SARS-CoV-2/Wuhan/WIV05/2019__EPI_ISL_402128 spike protein CDS gc (1-1147)(I909C_Y1047C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11962 - RNA, 3906 nt, Artificial Sequence
  SARS-CoV-2/Wuhan/WIV05/2019__EPI_ISL_402128 spike protein CDS gc (1-1147)(Q965C_S1003C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11963 - RNA, 3906 nt, Artificial Sequence
  SARS-CoV-2/Wuhan/WIV05/2019__EPI_ISL_402128 spike protein CDS gc (1-1147)(F970C_G999C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11964 - RNA, 3906 nt, Artificial Sequence
  SARS-CoV-2/Wuhan/WIV05/2019__EPI_ISL_402128 spike protein CDS gc (1-1147)(A972C_R995C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11965 - RNA, 3906 nt, Artificial Sequence
  SARS-CoV-2/Wuhan/WIV05/2019__EPI_ISL_402128 spike protein CDS gc (1-1147)(A890C_V1040C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11966 - RNA, 3906 nt, Artificial Sequence
  SARS-CoV-2/Wuhan/WIV05/2019__EPI_ISL_402128 spike protein CDS gc (1-1147)(T874C_S1055C) WhcAg construct
auguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcuga

SEQ ID NO: 11967 - RNA, 3822 nt, Artificial Sequence
  SARS-CoV-2/Wuhan/WIV05/2019__EPI_ISL_402128 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggauuccuucaaggaggaacuugacaaauacuuuaagaaccauacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguaugagcaguacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcacuacacauga

SEQ ID NO: 11968 - RNA, 3810 nt, Artificial Sequence
  SARS-CoV-2/bat/Yunnan/RaTG13/2013__EPI_ISL_402131 spike protein CDS human (1-1269)
auguucguguuucugguccuccuuccccugguuagcucccagugcgugaacuugaccacaagaacucaauuaccuccagccuacaccaauucuucaacgaggggcguauauuacccggacaagguguuccggaguagcguccugcaccuaacacaggaucucuuucugcccuucuuuuccaacgugacuugguuccaugcuauccacguuucugggaccaauggaauuaaacgcuuugacaacccugugcuuccauucaaugauggugucuauuuugcaucgacagagaagucaaacauaauccgaggcuggauuuucgggaccacucuggacagcaaaacacagaguuugcucaucgugaauaacgccaccaauguaguuauuaaggugugugaauuucaguucugcaacgaucccuuucugggagucuacuaucauaaaaauaacaaguccuggauggagucugaguuccguguguacagcuccgcgaauaacuguacguucgaauaugugucacaaccuuuucugauggaccucgaaggcaagcaggguaauuucaaaaacuuaagagaguuugucuucaagaacaucgauggguacuuuaaaauauacaguaagcacacuccaaucaaucugguuagggaccuucccccuggauucagcgcuuuggagccacugguggaucuaccgauuggcaucaacauuacccgguuucagacacuccuggcccuucaucgcucuuaucugacucccggcgacuccucaagcggguggaccgcaggagccgcugcauacuauguagguuacuugcagccuagaacauuccuccugaaauauaaugaaaacggcaccaucacggaugccguggacugcgcuuuagauccacugagugagacuaaguguacacucaagucuuuuaccgucgaaaaagggauauaccaaacuuccaauuucagggugcagcccacagacagcauuguucgguuuccuaacaucaccaaucuuugcccauucggagagguguuuaacgccacgaccuucgcgucggucuaugcauggaaucgcaagcgaauuucuaacuguguggccgacuacuccguacuguacaauucaacaaguuucagcacuuuuaaaugcuauggcguuucccccaccaaguugaacgaucuauguuucacaaauguguacgcugacucuuuugucaucacuggugaugaggugagacagaucgccccggggcagaccggaaaaauugcagacuauaacuacaagcugccugaugacuucacaggcugcgucauagcuuggaauagcaaacacaucgaugccaaggaaggcgggaacuuuaacuaucucuacaggcuguuccggaaggcgaaucuuaaacccuuugagcgugacauuucaaccgaaaucuaucaagccggaaguaagccauguaacggucagacuggccugaauugcuacuacccuuuguaucgcuacggguucuaucccacggauggagugggccaccagccauacagaguugugguacucuccuuugagcuguuaaacgcacccgcuacagucugcgguccuaaaaagagcaccaaucuggugaaaaacaaguguguuaauuucaacuuuaaugggcuaacuggcaccggagugcucacagaaucuaacaagaaauuccugccauuucaacaguucggcagggacauagccgauaccacugacgcuguccgggacccgcagacacuugagauuuuggauaucacgcccugcucauucgggggagugaguguaaucaccccugguacuaaugccagcaaccagguggcaguucuguaucaagacgucaauuguacagaggugccaguggccauucaugcugaucagcucacccccacauggcgagucuacuccacuggcucuaacguuuuucagacccgcgcggggugccugaucggagcagaacacgugaauaacucguaugagugugacauuccuauaggcgccgguaucugcgcuagcuaccagacgcaaaccaacuccagaucaguggccagucagucuauuaucgcauacacaaugagccuuggggccgaaaauuccguagcuuauucaaacaauagcaucgccauuccaacuaacuucaccauaucugucacaacugagauccugcccguguccaugaccaagacgaguguugauuguacaauguacauuugcggcgacagcaccgaauguucuaauuugcuccugcaguauggauccuuuugcacucaguuaaacagggcacugacaggcaucgcgguggagcaagauaaaaauacccaggaggucuucgcucaggugaagcagauuuacaaaacuccgccuaucaaggacuuugggggauucaacuuuucacaaauacuaccagaucccaguaagccuagcaaacggucguucaucgaagaccuccuguuuaauaagguuacccuugccgaugcagguuucauuaaacaguauggcgacuguuugggggauaucgccgcucgcgaccugauuugcgcccagaaguuuaacggacucacagugcugcccccauuacugacggacgagaugaucgcacaauacaccuccgcucuuuuggccggcacuauaacaucugguuggaccuucggggcgggcgccgcucuccagauuccuuucgcaaugcagauggccuauagauuuaauggaaucggcguaacacagaacguccuguacgaaaaucaaaaacuaauugcuaaccaguucaauagcgccaucgggaagauacaggauucacugaguuccacugcaucugcgcucggaaagcugcaggacguggugaaccaaaacgcccaggcucuuaauaccuuggucaaacagcugagcuccaacuuuggcgccaucucaagcguuuuaaaugauauucucaguaggcuggacaagguggaggcagaaguacagaucgaucgucuuauuacgggucggcugcaaucuuugcagacauacgugacccagcaacucauccgagcugccgagauaagagcauccgccaaccuggcugcgacuaaaaugagcgagugcguccuagggcagucgaagaggguggacuucuguggaaaaggcuaucaucugaugucauuuccccagucugccccacacgguguuguguuccuccacgucaccuacgugccggcacaggaaaagaauuuuacaacugcuccugccauuugccaugauggcaaagcccacuucccccgcgaggggguuuuugugaguaacggaacccauugguucgucacacaacggaauuuuuaugaaccacagaucaucacgaccgacaacacuuucguauccggcagcugugaugugguuauugggaucgugaauaacacagucuacgacccccugcagccugagcuugauucuuuuaaggaggaauuggacaaguauuucaaaaaucacaccagcccagauguggaccugggagacauuuccggcauaaacgcuucaguagugaauauccagaaggagauugauagauuaaacgaagucgccaaaaaucucaacgagagucugaucgaccuucaagaacuggguaaguacgagcaguauauuaaauggcccugguacaucuggcuaggguucauagcaggacucaucgcgauuaucaugguuacuauuaugcugugcuguaugacaagcugcuguucuugcuugaagggcuguugcuccugugguucaugcugcaaguuugaugaggacgauagugaaccugugcugaaaggcgugaaguuacauuacaccuga

SEQ ID NO: 11969 - RNA, 3822 nt, Artificial Sequence
  SARS-CoV-2/Wuhan/HBCDC-HB-01/2019__EPI_ISL_402132 spike protein CDS human (1-1273)
auguucguguuucugguccuccuuccccugguuagcucccagugcgugaacuugaccacaagaacucaauuaccuccagccuacacuaauucuaucaccaggggcguauauuacccggacaagguguuccggucaaguguccugcacagcacacaggaucuauuucuccccuucuuuuccaacgugacuugguuccaugcuauucacguuucugggaccaauggaacaaaacgcuuugacaacccugugcugccauucaaugauggugucuauuuugcaucgaccgagaagucaaacauaauccgaggcuggauuuucgggacuacacuugacagcaaaacccagagucuguugaucgugaauaacgccacgaauguaguuauuaaggugugugaauuucaguucugcaacgaucccuuucucggagucuacuaucauaaaaauaacaaguccuggauggagucugaguuccguguguacagcuccgcgaauaacuguacuuucgaguaugugucacaaccuuuucugauggaccuggaaggcaagcaggguaauuucaaaaaccucagagaguuugucuucaagaacaucgauggguacuuuaaaauauacaguaagcacaccccaaucaauuuaguuagggaccugccccagggauucagcgcucuugagccuuugguggaucugccaauuggcaucaacauuacacgguuucagacucuacucgcccugcaucgcucuuaucuuaccccgggcgacuccucaagcggguggacagcaggagccgcugcauacuauguagguuaccugcaacccagaaccuucuugcucaaauauaaugaaaacggcacgaucacugaugccguggacugcgcucuggauccuuuaagugagacaaaguguacccugaagucuuuuacugucgaaaaagggauauaccagacauccaauuucagggugcagccaaccgagagcauuguucgguuucccaacaucacgaaucucugcccuuucggagagguguuuaacgccacccgcuucgcgucggucuaugcauggaaucgaaagagaauuucuaacuguguggccgacuacuccguacuuuacaauucagcuaguuucagcacauuuaaaugcuauggcguuuccccaacuaagcugaacgacuuguguuucaccaauguguacgccgauucuuuugucaucaggggugacgaagugcggcagaucgcacccgggcaaacaggaaaaauugcugauuauaacuacaagcuaccggacgauuucacuggcugcgucauagccuggaauagcaacaaccuggacucaaaagugggcgggaauuauaacuaccucuaucgucuguuucgcaagaguaaucuuaagccuuucgagagagauaucuccaccgaaauuuaccaggcgggaagcacacccuguaacgguguugagggcuuuaauugcuacuucccacugcagucuuauggguuucaaccuaccaacggagugggcuaccagcccuauaggguagucguguugucauucgaacuccugcacgccccagcaacuguuugcggucccaaaaagaguacgaauuuagugaaaaacaagugugucaauuuuaacuucaaugggcugacaggcaccggagugcuaacugagagcaacaaaaaguuucucccuuuccagcaguucggccgggacaucgcugauaccacagacgccguacgagauccacaaacccuggagauacuugacauuacuccgugcuccuuugggggagugucuguuaucacacccgguacgaauaccucgaaccaggucgcuguguuguaccaggacgugaauuguacugaagucccuguugccauccacgcagaucagcugacaccaaccuggcgcguguauagcacaggcuccaacguguuccaaacuagagccgggugccucauuggagcugagcauguaaacaauucauacgaaugugacauccccauuggcgcggguauaugcgcaaguuaucagacccagacgaacucuccuaggcgggcccgcagcgucgcuucccagucaaucauugccuacaccaugagccugggggcagaaaauucuguggccuacuccaacaauaguaucgcuaucccaacaaacuuuacuauuagcguuaccacagaaauacuucccgugucuaugacuaagaccuccgucgauuguacgauguauaucugcggcgacucaacagaguguaguaaucuguugcuccaauacggcagcuucugcacccagcugaacagagccuuaacuggaauugcaguggagcaggauaaaaauacacaggaaguuuuugcgcaagugaagcagaucuauaaaaccccgccuauuaaggacuucgggggauuuaacuucucgcagauccugccagaucccuccaaaccuucuaagaggagcuuuauagaggaccuacucuucaauaagguaacucuggcugaugccgguuuuaucaaacaauacggcgacugucuuggggauauugcagcccgugacuugaucugcgcucagaaguucaacggacugaccguccugcccccacucuuaacagaugaaaugauugcccaguauacgucagcacugcuugcuggcaccaucacgagugguuggacauucggggccggcgcggccuugcagauaccuuuugcuaugcaaauggcauaccgguucaauggaauuggcgugacccagaacgugcucuaugagaaucagaaacugaucgccaaccaguuuaacuccgcuauugggaagauccaagacucucuaagcuccacagccucagcacugggaaaacuccaggacgucguuaaucagaacgcgcaggcccugaauacucuugugaagcaauugagcaguaacuucggcgcuauaucuuccguacugaaugauaucuuaagccgacucgacaagguggaagccgagguccagauugauagacugaucaccgguaggcuucagucgcugcaaacguacgugacacagcaguugauucgcgcagcugagauccgggccucagcaaaccucgccgcuaccaaaaugucugaaugcguucuggggcagaguaagagaguggacuuuuguggaaaaggcuaccaccuaauguccuucccccaaagcgcgccacauggugucguguuucugcacguuacuuaugugccggcccaggagaagaauuucaccacagcuccugcaauaugccacgauggcaaagcccauuuucccagggaaggggucuucguaucuaacggaacucacugguuugugacccagcgcaauuucuacgagccacagauuaucacaacggacaacaccuuuguuagcggcaauugugauguggucaucgggauugugaacaauacuguauaugacccccuccaaccugagcuggauuccuucaaggaggaacuugacaaauacuucaagaaccauacaucaccagauguggacuugggagauaucaguggcauuaaugccagcgucguuaacauacagaaggaaaucgaccgacugaaugagguggcuaaaaacuuaaacgaaucucucauugaccugcaggagcuugguaaguaugagcaguacaucaaauggcccugguauauuuggcugggguuuaucgcaggacuaauagccaucgugauggucaccauuaugcucugcuguaugacuuccugcuguucaugccugaagggcuguugcaguugugguagcugcugcaaauucgaugaagacgauuccgagccuguguugaagggcguuaagcugcacuacacauga

SEQ ID NO: 11970 - RNA, 3822 nt, Artificial Sequence
  SARS-CoV-2/Guangdong/20SF028/2020__EPI_ISL_403936 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccuguauagcacacaggaucuauuccuccccuuuuucuccaacgugacuugguuucacgcuauccauguuucugggaccaauggaacaaaacgcuucgacaacccugugcugccauuuaaugauggugucuacuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuauuaccacaaaaauaacaaguccuggauggagucugaguuccguguguauagcuccgcgaauaacuguacuuuugaauacgugucacaaccuuuccugauggaccuggaaggcaagcaggguaauuuuaaaaaccucagagaguucgucuuuaagaacauugauggguacuucaaaaucuauaguaagcauaccccaauaaauuuaguuagggaccugccccagggauuuagcgcucuugagccuuugguggaucugccaaucggcauuaacaucacacgguuccagacucuacucgcccugcaccgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuacuccguacuuuauaauucagcuaguuuuagcacauucaaaugcuacggcguuuccccaacuaagcugaacgacuuguguuuuaccaauguguaugccgauucuuucgucauuaggggugacgaagugcggcagaucgcacccgggcaaacaggaaaaaucgcugauuacaacuauaagcuaccggacgauuuuacuggcugcgucauugccuggaauagcaacaaccuggacucaaaagugggcgggaauuacaacuaucucuaccgucuguuccgcaagaguaaucuuaagccuuuugagagagauauauccaccgaaaucuaccaggcgggaagcacacccuguaacgguguugagggcuucaauugcuauuuuccacugcagucuuacggguuccaaccuaccaacggagugggcuaucagcccuacaggguagucguguugucauuugaacuccugcaugccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaucaggacgugaauuguacugaagucccuguugccauccacgcagaucagcugacaccaaccuggcgcguguacagcacaggcuccaacguguuucaaacuagagccgggugccucaucggagcugagcacguaaacaauucauaugaaugugacauucccaucggcgcggguauuugcgcaaguuaccagacccagacgaacucuccuaggcgggcccgcagcgucgcuucccagucaauaaucgccuacaccaugagccugggggcagaaaauucuguggccuauuccaacaauaguauugcuaucccaacaaacuucacuaucagcguuaccacagaaauucuucccgugucuaugacuaagaccuccgucgauuguacgauguacauaugcggcgacucaacagaguguaguaaucuguugcuccaauauggcagcuuuugcacccagcugaacagagccuuaacuggaaucgcaguggagcaggauaaaaauacacaggaaguuuucgcgcaagugaagcagauuuacaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauauggcgacugucuuggggauaucgcagcccgugacuugauuugcgcucagaaguucaacggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaauggaauaggcgugacccagaacgugcucuacgagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaucaucuaauguccuuuccccaaagcgcgccacacggugucguguuccugcauguuacuuacgugccggcccaggagaagaauuuuaccacagcuccugcaaucugccacgauggcaaagcccacuuccccagggaaggggucuuuguaucuaacggaacucauugguucgugacccagcgcaauuuuuaugagccacagauaauuacaacggacaacaccuucguuagcggcaauugugauguggucaucgggaucgugaacaauacuguauacgacccccuccaaccugagcuggauuccuucaaggaggaacuugacaaauauuuuaagaaccacacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcauuacacauga

SEQ ID NO: 11971 - RNA, 3822 nt, Artificial Sequence
  SARS-CoV-2/Shenzhen/SZTH-001/2020__EPI_ISL_406592 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugaugugcucaucgggaucgucaacaauacuguguaugacccccugcaaccugagcuugauuccuucaaggaagaguuggacaaauacuuuaagaaccauacaucaccagauguagaccugggagauauuaguggcaucaaugccagcguggucaacauucagaaggaaauagaccgauuaaaugagguugcuaaaaaccucaacgaaucucugaucgaccuucaggagcuggguaaguaugagcaguacauuaaauggcccugguauaucuggcuaggguucauugcaggacucaucgccauagugauggugaccaucaugcugugcuguaugacuuccugcuguucaugcuugaagggcuguugcaguugugguagcugcugcaaauuugaugaagacgauuccggcccuguccugaagggggugaaguuacacuacacauga

SEQ ID NO: 11972 - RNA, 3822 nt, Artificial Sequence
  SARS-CoV-2/Shenzhen/SZTH-004/2020__EPI_ISL_406595 spike protein CDS human (1-1273)
auguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcaugggaccgaaagagaaucucuaauuguguggccuacuacuccguacuuuauaacucagcuaguuuuagcacauucaaaugcuacggcguuuccccaacuaagcugaaugacuuguguuuuaccaacguguaugccgauucuuucgucauuaggggugacgaagugcggcagaucgcacccgggcaaacaggaaaaaucgcugauuacaauuauaagcuaccggacgauuuuacuggcugcgucauugccuggaacagcaauaaccuggacucaaaagugggcgggaacuacaauuaucucuaccgucuguuccgcaagaguaaccuuaagccuuuugagagagauauauccaccgaaaucuaccaggcgggaagcacacccuguaaugguguugagggcuucaacugcuauuuuccacugcagucuuacggguuccaaccuaccaauggagugggcuaucagcccuacaggguagucguguugucauuugaacuccugcacgccccagcaacuguuugcggucccaaaaagaguacgaacuuagugaaaaauaagugugucaacuucaauuuuaacgggcugacaggcaccggagugcuaacugagagcaauaaaaaguuccucccuuuccagcaguuuggccgggacauugcugauaccacagacgccguacgagauccacaaacccuggagauccuugacauaacuccgugcuccuucgggggagugucuguuauuacacccgguacgaacaccucgaaucaggucgcuguguuguaucaggacgugaacuguacugaagucccuguugccauccacgcagaucagcugacaccaaccuggcgcguguacagcacaggcuccaauguguuucaaacuagagccgggugccucaucggagcugagcauguaaacaacucauaugaaugugacauucccaucggcgcggguauuugcgcaaguuaccagacccagacuaauucuccuaggcgggcccgcagcgucgcuucccagucaauaaucgccuacaccaugagccugggggcagagaacucuguggccuauuccaauaacaguauugcuaucccaacaaauuucacuaucagcguuaccacagaaauucuucccgugucuaugacuaagaccuccgucgauuguacgauguacauaugcggcgacucaacagaguguaguaaccuguugcuccaauauggaucuuuuugcacccagcugaauagagccuuaacuggcaucgcaguggagcaggauaaaaacacacaggaaguuuucgcgcaagugaagcagauuuacaaaaccccgccuaucaaggacuuugggggauucaauuuuucgcagauucugccagaucccuccaaaccuucuaagaggagcuucaucgaggaccuacucuuuaacaagguaacucuggcugaugccgguuucauaaaacaauauggcgacugucuuggggauaucgcagcccgugacuugauuugcgcucagaaguucaauggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaacggaauaggcgugacccagaaugugcucuacgagaaccagaaacugauugccaaucaguucaacuccgcuaucgggaagauucaagacucucuaagcuccacagccucagcacugggaaaacuccaggacgucguuaaccagaaugcgcaggcccugaacacucuugugaagcaauugagcaguaauuuuggcgcuaucucuuccguacugaacgauauauuaagccgacucgacaagguggaagccgagguccagaucgauagacugauuaccgguaggcuucagucgcugcaaacguacgugacacagcaguugauccgcgcagcugagauucgggccucagcaaaucucgccgcuaccaaaaugucugaaugcguucuggggcagaguaagagaguggacuucuguggaaaaggcuaucaccuaauguccuuuccccaaagcgcgccacauggugucguguuccugcacguuacuuacgugccggcccaggagaagaacuuuaccacagcuccugcaaucugccacgauggcaaagcccauuuccccagggaaggggucuuuguaucuaauggaacucacugguucgugacccagcgcaacuuuuaugagccacagauaauuacaacggacaauaccuucguuagcggcaacugugauguggucaucgggaucgugaauaacacuguauacgacccccuccaaccugagcuggauuccuucaaggaagaacuugacaaauauuuuaagaaucauacaucaccagauguggacuugggagauauuaguggcaucaacgccagcgucguuaauauucagaaggaaauagaccgacugaacgagguggcuaaaaauuuaaacgaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcacuacacauga

SEQ ID NO: 11973 - RNA, 3822 nt, Artificial Sequence
  SARS-CoV-2/France/IDF0372/2020__EPI_ISL_406596 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccuuucuuuacaauucagcuaguuucagcacauuuaaaugcuauggcguauccccaacuaagcugaacgacuuguguuucaccaauguuuacgccgauucuuuugugauuaggggugacgaaguccggcagaucgcacccgggcaaacaggaaaaaucgcugauuauaacuacaagcuaccggacgauuucacuggcugcgugauugccuggaauagcaacaaccuggacucaaaagucggcgggaauuauaacuaccucuaucgucuguuucgcaagaguaaucuuaagccuuucgagagagauauauccaccgaaaucuaccaggcgggaagcacacccuguaacgguguggagggcuuuaauugcuacuucccacugcagucuuauggguuucaaccuaccaacggaguuggcuaccagcccuauagggugguagucuugucauucgaacuccugcacgccccagcaacugugugcggucccaaaaagaguacgaauuuaguuaaaaacaagugugugaauuuuaacuucaaugggcugacaggcaccggaguccuaacugagagcaacaaaaaguuccucccuuuucagcaguucggccgggacauugcugauaccacagacgccgugcgagauccacaaacccuggagauccuugacauaacuccgugcuccuuugggggaguaucugugauuacacccgguacgaauaccucgaaccagguugcugucuuguaccaggacgugaauuguacugaagugccugucgccauccacgcagaucagcugacaccaaccuggcgcguuuauagcacaggcuccaacguguuccaaacuagagccgggugccucaucggagcugagcaugugaacaauucauacgaaugugacauucccaucggcgcggguauuugcgcaaguuaucagacccagacgaacucuccuaggcgggcccgcagcguagcuucccagucaauaaucgccuacaccaugagccugggggcagaaaauucugucgccuacuccaacaauaguauugcuaucccaacaaacuuuacuaucagcgugaccacagaaauucuucccguuucuaugacuaagaccuccguggauuguacgauguauauaugcggcgacucaacagaguguaguaaucuguugcuccaauacggcagcuucugcacccagcugaacagagccuuaacuggaaucgcagucgagcaggauaaaaauacacaggaaguguuugcgcaaguuaagcagauuuauaaaaccccgccuaucaaggacuucgggggauuuaacuucucgcagauucugccagaucccuccaaaccuucuaagaggagcuuuaucgaggaccuacucuucaauaaggugacucuggcugaugccgguuucauaaaacaauacggcgacugucuuggggauaucgcagcccgugacuugauuugcgcucagaaguuuaacggacugaccguacugcccccacucuuaacagaugaaaugaucgcccaguauacgucagcacugcuugcuggcaccauuacgagugguuggacauucggggccggcgcggccuugcagaucccuuuugcuaugcaaauggcauaccgguucaauggaauaggcgucacccagaacgugcucuaugagaaucagaaacugauugccaaccaguuuaacuccgcuaucgggaagauucaagacucucuaagcuccacagccucagcacugggaaaacuccaggacguggucaaucagaacgcgcaggcccugaauacucuuguuaagcaauugagcaguaacuucggcgcuaucucuuccgugcugaaugauauauuaagccgacucgacaagguagaagccgaggugcagaucgauagacugauuaccgguaggcuucagucgcugcaaacguacgucacacagcaguugauccgcgcagcugagauucgggccucagcaaaccucgccgcuaccaaaaugucugaaugcgugcuggggcagaguaagagaguugacuuuuguggaaaaggcuaccaccuaauguccuucccccaaagcgcgccacaugguguggucuuucugcacgugacuuauguuccggcccaggagaagaauuucaccacagcuccugcaaucugccacgauggcaaagcccauuuucccagggaagggguguucgucucuaacggaacucacugguuuguaacccagcgcaauuucuacgagccacagauaauuacaacggacaacaccuucgugagcggcaauugugauguugugaucgggaucgucaacaauacuguguaugacccccuccaaccugagcuggauuccuuuaaggaggaacuugacaaauacuucaagaaccauacaucaccagauguagacuugggagauauuaguggcaucaaugccagcguggucaacauucagaaggaaauagaccgacugaaugagguugcuaaaaacuuaaacgaaucucucaucgaccugcaggagcuugguaaguaugagcaguacauuaaauggcccugguauaucuggcugggguuuauugcaggacuaaucgccauagugauggugaccaucaugcucugcuguaugacuuccugcuguucaugccugaagggcuguugcaguugugguagcugcugcaaauucgaugaagacgauuccgagccugucuugaagggcgugaagcugcacuacacauga

SEQ ID NO: 11974 - RNA, 3822 nt, Artificial Sequence
  SARS-CoV-2/Australia/VIC01/2020__EPI_ISL_406844 spike protein CDS human (1-1273)
auguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcagauaucuuaccccgggcgacucuuccucaggguggacagcaggagccgcugcauacuauguagguuaccugcaacccaggaccuuuuugcucaaauauaaugaaaacggcacgauuacugaugccguggacugcgcucuggauccuuuaagcgagacaaaguguacccugaagaguuucacugucgaaaaagggaucuaccagacaucuaauuuucgggugcagccaaccgaguccauaguucgcuuccccaacauuacgaaucucugcccuuuuggagagguguucaacgccacccgauucgcgagcgucuaugcauggaauagaaagaggaucucgaacuguguggccgacuacucuguacuuuacaauuccgcuucauuuaguacauucaaaugcuauggcguuagcccaacuaagcugaacgacuuguguuuuaccaauguguacgccgauuccuucgucauucggggugacgaagugcgucagaucgcacccgggcaaacaggaaaaaucgcugauuauaacuacaagcuaccggacgauuuuacuggcugcgucauugccuggaacucuaauaaccuggacagcaaagugggcgggaauuauaacuaccucuaucgccuguucagaaagucaaaucuuaagccuuuugagagggauauaaguaccgaaaucuaccaggcgggauccacacccuguaacgguguugagggcuucaauugcuacuuuccacugcagagcuauggguuccaaccuaccaacggagugggcuaccagcccuaucggguagucguguugucuuuugaacuccugcacgccccagcaacuguuugcggucccaaaaagucaacgaauuuagugaaaaacaagugugucaauuucaacuuuaaugggcugacaggcaccggagugcuaacugagaguaacaaaaaguuccucccuuuccagcaguuuggccgagacauugcugauaccacagacgccguacgcgauccacaaacccuggagauccuugacauaacuccgugcagcuucgggggaguguccguuauuacacccgguacgaauaccucuaaccaggucgcuguguuguaccaggacgugaauuguacugaagucccuguugccauccacgcagaucagcugacaccaaccuggagaguguauucgacaggcagcaacguguuucaaacuagggccgggugccucaucggagcugagcauguaaacaauuccuacgaaugugacauucccaucggcgcggguauuugcgcaucauaucagacccagacgaacaguccucggcgcgccagaucugucgcuagccaguccauaaucgccuacaccaugucacugggggcagagaauagcguggccuacucuaacaauuccauugcuaucccaacaaacuucacuaucaguguuaccacagaaauucuucccgugagcaugacuaagaccucugucgauuguacgauguauauaugcggcgacuccacagaguguucaaaucuguugcuccaauacggaaguuuuugcacccagcugaacagggccuuaacuggcaucgcaguggagcaggauaaaaauacacaggaaguuuucgcgcaagugaagcagauuuauaaaaccccgccuaucaaggacuuugggggauucaacuuuagccagauucugccagaucccucgaaaccuuccaagcguucuuucaucgaggaccuacucuuuaauaagguaacucuggcugaugccgguuucauaaaacaauacggcgacugucuuggggauaucgcagcccgggacuugauuugcgcucagaaguucaacggacugaccguccucccuccacuguuaacagaugaaaugaucgcccaguauacgagcgcacugcuugcuggcaccauuacuucagguuggacauuuggggccggcgcggccuugcagaucccuuucgcuaugcaaauggcauaccgauuuaauggaauaggcgugacccagaacgugcucuaugagaaucagaaacugauugccaaccaguucaacagugcuaucgggaagauucaagacucccuaucuagcacagccuccgcacugggaaaacuccaggacgucguuaaucagaacgcgcaggcccugaauacucuugugaagcaauugucaagcaacuuuggcgcuaucaguucuguacugaaugauauauuauccagacucgacaagguggaagccgagguccagaucgauaggcugauuaccggucgccuucagagccugcaaacguacgugacacagcaguugauccgggcagcugagauuagagccucggcaaaccucgccgcuaccaaaaugucagaaugcguucuggggcagucuaagaggguggacuucuguggaaaaggcuaccaccuaaugaguuuuccccaauccgcgccacauggugucguguuccugcacguuacuuaugugccggcccaggagaagaauuuuaccacagcacccgcuaucugccacgauggcaaagcccauuucccccgcgaaggggucuuuguaagcaacggaacucacugguucgugacccagcgaaauuuuuacgagccacagauaauuacaacggacaacaccuucguuucuggcaauugugauguggucaucgggaucgugaacaauacuguauaugacccccuccaaccugagcuggauagcuucaaggaagaacuugacaaauacuuuaagaaccauacauccccagauguggacuugggagauauuucaggcaucaaugccagugucguuaacauucagaaggaaauagaccggcugaaugagguggcuaaaaacuuaaacgaaagccucaucgaccugcaggagcuugguaaguaugagcaguacauuaaauggcccugguauaucuggcugggguucauugcaggacuaaucgccauagugauggucaccaucaugcucugcuguaugacuucuugcuguuccugccugaagggcuguugcucaugugguaguugcugcaaauuugaugaagacgauagcgagccuguguugaagggcguuaagcugcacuacacauga

SEQ ID NO: 11975 - RNA, 3822 nt, Artificial Sequence
  SARS-CoV-2/Germany/BavPat1/2020__EPI_ISL_406862 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcacuacacauga

SEQ ID NO: 11976 - RNA, 3822 nt, Artificial Sequence
  SARS-CoV-2/Wuhan/HBCDC-HB-02/2020__EPI_ISL_412978 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaauuuucuguugcaauacggcagcuucugcacccagcucaacagagcccugacuggaaucgcaguggagcaggauaaaaauacacaggaaguuuuugcgcaagugaagcagauuuauaaaaccccgccuaucaaggacuucgggggauuuaacuucucgcagauuuuaccagaucccuccaaaccuucuaagaggagcuuuaucgaggaccugcuauucaauaagguaacucucgcugaugccgguuucauaaaacaauacggcgacugucugggggauaucgcagcccgugaccuuauuugcgcucagaaguuuaacggauugaccguccugcccccacuccugacagaugaaaugaucgcccaguauacgucagcauuacuggcuggcaccauuacgagugguuggacauucggggccggcgcggcccuucagaucccuuuugcuaugcaaauggcauaccgguucaauggaauaggcgugacccagaacguguuguaugagaaucagaaacucauugccaaccaguuuaacuccgcuaucgggaagauucaagacucucugagcuccacagccucagcacuaggaaaacugcaggacgucguuaaucagaacgcgcaggcccucaauacucuggugaagcaacuuagcaguaacuucggcgcuaucucuuccguauugaaugauauacugagccgauuagacaagguggaagccgagguccagaucgauagacucauuaccgguaggcugcagucgcuucaaacguacgugacacagcagcugauccgcgcagcugagauucgggccucagcaaacuuggccgcuaccaaaaugucugaaugcguucucgggcagaguaagagaguggacuuuuguggaaaaggcuaccaccugauguccuucccccaaagcgcgccacauggugucguguuucuacacguuacuuaugugccggcccaggagaagaauuucaccacagcuccugcaaucugccacgauggcaaagcccauuuucccagggaaggggucuucguaucuaacggaacucacugguuugugacccagcgcaauuucuacgagccacagauaauuacaacggacaacaccuucguuagcggcaauugugauguggucaucgggaucgugaacaauacuguauaugacccccugcaaccugagcucgauuccuuuaaggaagaacuggacaaauacuucaagaaccauacaucaccagauguggaccuuggagauauuaguggcaucaaugccagcgucguuaacauucagaaggaaauagaccgauugaaugagguggcuaaaaaccugaacgaaucuuuaaucgaccuccaggagcuggguaaguaugagcaguacauuaaauggcccugguauaucuggcuuggguuuauugcaggacugaucgccauagugauggucaccaucaugcuaugcuguaugacuuccugcuguucaugccucaagggcuguugcaguugugguagcugcugcaaauucgaugaagacgauuccgagccugugcugaagggcguuaaguugcacuacacauga

SEQ ID NO: 11977 - RNA, 3822 nt, Artificial Sequence
  SARS-CoV-2/Australia/QLD02/2020__EPI_ISL_407896 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaacuggagcuugauuccuucaaggaagaguuggacaaauacuuuaagaaccauacaucaccugauguggaccugggagauauuaguggcaucaaugccagcgucguuaacauucagaaggaaauagaccgauuaaaugagguggcuaaaaaccucaacgaaucucugaucgaccuucaggagcuggguaaguaugagcaguacauuaaauggccaugguauaucuggcuaggguucauugcaggacucaucgccauagugauggucaccaucaugcugugcuguaugacuuccugcuguucaugcuugaagggcuguugcaguugugguagcugcugcaaauuugaugaagacgauuccgagcccgugcugaagggcguuaaguuacacuacacauga

SEQ ID NO: 11978 - RNA, 3822 nt, Artificial Sequence
  SARS-CoV-2/India/1-31/2020__EPI_ISL_413523 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgucaucgggaagauucaagacucucuaagcuccacagcuucagcccugggaaaacuccaggacguugugaaucagaacgcacaggcgcugaauacucuuguaaagcaauugagcaguaacuuuggcgccaucucuuccgugcugaaugauauauuaagccgacucgacaaggucgaagcugaggugcagaucgauagacugauuaccgguaggcuucagucgcugcaaacguacguuacacagcaguugauccgcgccgcagagauucgggcuucagccaaccucgcagccaccaaaaugucugaaugcgugcuggggcagaguaagagagucgacuucuguggaaaaggcuaccaccuaauguccuuuccccaaagcgcuccacauggugugguuuuccugcacgugacuuaugucccggcgcaggagaagaauuuuaccacagccccugcaaucugccacgauggcaaagcucauuuccccagggaagggguauuugugucuaacggaacucacugguucguuacccagcgcaauuuuuacgagccacagauaauuacaacggacaacaccuucgugagcggcaauugugaugucgugaucgggaucguaaacaauacuguguaugacccccuccaaccugagcuggauuccuucaaggaggaacuugacaaauacuuuaagaaccauacaucaccagaugucgacuugggagauauuaguggcaucaaugccagcguugugaacauucagaaggaaauagaccgacugaaugagguggccaaaaacuuaaacgaaucucucaucgaccugcaggagcuugguaaguaugagcaguacauuaaauggcccugguauaucuggcugggguucauugcuggacuaaucgcaauagucauggugaccaucaugcucugcuguaugacuuccugcuguucaugccugaagggcuguugcaguugugguagcugcugcaaauuugaugaagacgauuccgagccuguuuugaagggcguaaagcugcacuacacauga

SEQ ID NO: 11979 - RNA, 3822 nt, Artificial Sequence
  SARS-CoV-2/Guangdong/GD2020087-P0008/2020__EPI_ISL_413863 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggaaucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcgggagaucgcacccgggcagacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugaaagagauauauccaccgagaucuaccaagcgggaagcacacccuguaacgguguugaaggcuucaauugcuacuuuccacugcagucuuauggguuccagccuaccaacggagugggcuaccaacccuauaggguagucguguugucauuugagcuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacagacccuggaaauccuugacauaacuccgugcuccuucgggggagugucuguuauuacacccgguacgaauaccucgaaccaagucgcuguguuguaccaggacgugaauuguacugaggucccuguugccauccacgcagaucagcugacaccaaccuggcgcguguauagcacaggcuccaacguguuucagacuagagccgggugccucaucggagcugaacauguaaacaauucauacgagugugacauucccaucggcgcggguauuugcgcaaguuaucaaacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagagauucuucccgugucuaugacuaagaccuccgucgauuguacgauguauauaugcggcgacucaacagaguguaguaaucuguugcuccaguacggcagcuuuugcacccaacugaacagagccuuaacuggaaucgcaguggaacaggauaaaaauacacaggagguuuucgcacaggugaagcaaauuuauaaaaccccgccuaucaaggacuuugggggauucaacuuuucgcagauucugccagaucccuccaaaccuucuaagaggagcuucaucgaagaccuacucuuuaauaagguaacucuggcugaugccgguuucauaaaacaguacggcgacugucuuggggauaucgcagcccgugacuugauuugcgcucaaaaguucaacggacugaccguccugcccccacucuuaacagaugagaugaucgcccaguauacgucagcacugcuugcuggcaccauuacgagugguuggacauuuggggccggcgcggccuugcagaucccuuucgcuaugcagauggcauaccgguuuaauggaauaggcgugacccaaaacgugcucuaugaaaaucagaaacugauugccaaccaguucaacuccgcuaucgggaagauucaggacucucuaagcuccacagccucagcacugggaaaacuccaagacgucguuaaucagaacgcgcaggcccugaauacucuugugaagcaguugagcaguaacuuuggcgcuaucucuuccguacugaaugauauauuaagccgacucgacaagguggaggccgagguccaaaucgauagacugauuaccgguaggcuucagucgcugcagacguacgugacacaacaguugauccgcgcagcugaaauucgggccucagcaaaccucgccgcuaccaaaaugucugagugcguucuggggcagaguaagagaguggacuucuguggaaaaggcuaccaccuaauguccuuuccccagagcgcgccacauggugucguguuccugcacguuacuuaugugccggcccaagaaaagaauuuuaccacagcgccugcuaucugccacgauggcaaagcccauuuccccagggagggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccagccugaacuggauuccuucaaggaggaacuugacaaauacuuuaagaaccauacaucaccagauguggacuugggagauauuaguggcaucaaugccagcgucguuaacauucaaaaggagauagaccgacugaaugaaguggcuaaaaacuuaaacgagucucucaucgaccugcaggagcuugguaaguaugaacaguacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugaugaggacgauuccgaaccuguguugaagggcguuaagcugcacuacacauga

SEQ ID NO: 11980 - RNA, 3822 nt, Artificial Sequence
  SARS-CoV-2/Sweden/01/2020__EPI_ISL_411951 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacugugggggauuuaacuucucgcagauucugccagaucccuccaaaccuucuaagaggagcuuuaucgaggaccuacucuucaauaagguaacucuggcugaugccgguuuuauaaaacaauacggcgacugccuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauucggggccggcgcggccuugcagaucccuuuugcuaugcaaauggcauaccgguucaauggaauaggcgugacccagaacgugcucuaugagaaucagaaacugauugccaaccaguuuaacuccgcuaucgggaagauucaagacucucuaagcuccacagccucagcacugggaaaacuccaggacgucguuaaucagaacgcgcaggcccugaauacucuugugaagcaauugagcaguaacuucggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaauguguucuggggcagaguaagagaguggacuuuugcggaaaaggcuaccaccuaauguccuucccccaaagcgcgccacauggugucguguuucugcacguuacuuaugugccggcccaggagaagaauuucaccacagcuccugcaaucugucacgauggcaaagcccauuuucccagggaaggggucuucguaucuaacggaacucacugguuugugacccagcgcaauuucuacgagccacagauaauuacaacggacaacaccuuuguuagcggcaauugcgauguggucaucgggaucgugaacaauacuguauaugacccccuccaaccugagcuggauuccuucaaggaggaacuugacaaauacuucaagaaccauacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguaugagcaguacauuaaauggcccugguauaucuggcugggguuuauugcaggacuaaucgccauagugauggucaccaucaugcucuguugcaugacuuccuguugcucaugucugaagggcugcuguaguugcgguagcugcuguaaauucgaugaagacgauuccgagccuguguugaagggcguuaagcugcacuacacauga

SEQ ID NO: 11981 - RNA, 3822 nt, Artificial Sequence
  SARS-CoV-2/Tianmen/HBCDC-HB-07/2020__EPI_ISL_412983 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggaccugaauuguacugaagugccugucgccauccacgcagaucagcucacaccaaccuggcgcguuuauagcacaggcuccaacguguuucaaacuagagccgggugccugaucggagcugagcaugugaacaauucauacgaaugugacauucccaucggcgcggguauuugcgcaaguuaucagacccagacgaacucuccuaggcgggcccgcagcguagcuucccagucaauaaucgccuacaccaugagccuuggggcagaaaauucugucgccuacuccaacaauaguauugcuaucccaacaaacuucacuaucagcgugaccacagaaauucugcccguuucuaugacuaagaccuccguggauuguacgauguauauaugcggcgacucaacagaguguaguaauuugcuccugcaauacggcagcuuuugcacccaguuaaacagagcccugacuggaaucgcagucgagcaggauaaaaauacacaggaaguguucgcgcaaguuaagcagauuuauaaaaccccgccuaucaaggacuuugggggauucaacuuuucgcagauucuaccagaucccuccaaaccuucuaagaggagcuucaucgaggaccuccuguuuaauaaggugacucuugcugaugccgguuucauaaaacaauacggcgacuguuugggggauaucgcagcccgugaccugauuugcgcucagaaguucaacggacucaccguacugcccccauuacugacagaugaaaugaucgcccaguauacgucagcacuuuuggcuggcaccauuacgagugguuggacauuuggggccggcgcggcccuccagaucccuuucgcuaugcaaauggcauaccgguuuaauggaauaggcgucacccagaacgugcuguaugagaaucagaaacuaauugccaaccaguucaacuccgcuaucgggaagauucaagacucucugagcuccacagccucagcacucggaaaacugcaggacguggucaaucagaacgcgcaggcccuuaauacuuugguuaagcaacugagcaguaacuuuggcgcuaucucuuccguguuaaaugauauacucagccgacuggacaagguagaagccgaggugcagaucgauagacuuauuaccgguaggcugcagucguugcaaacguacgucacacagcagcucauccgcgcagcugagauucgggccucagcaaaccuggccgcuaccaaaaugucugaaugcgugcuagggcagaguaagagaguugacuucuguggaaaaggcuaccaccugauguccuuuccccaaagcgcgccacaugguguggucuuccuccacgugacuuauguuccggcccaggagaagaauuuuaccacagcuccugcaaucugccacgauggcaaagcccauuuccccagggaagggguguuugucucuaacggaacucacugguucguaacccagcgcaauuuuuacgagccacagauaauuacaacggacaacaccuucgugagcggcaauugugauguugugaucgggaucgucaacaauacuguguaugacccccugcaaccugagcuugauuccuucaaggaagaguuggacaaauacuuuaagaaccauacaucaccagauguagaccugggagauauuaguggcaucaaugccagcguggucaacauucagaaggaaauagaccgauuaaaugagguugcuaaaaaccucaacgaaucucugaucgaccuucaggagcuggguaaguaugagcaguacauuaaauggcccugguauaucuggcuaggguucauugcaggacucaucgccauagugauggugaccaucaugcugugcuguaugacuuccugcuguucaugcuugaagggcuguugcaguugugguagcugcugcaaauuugaugaagacgauuccgagccuguccugaagggcgugaaguuacacuacacauga

SEQ ID NO: 11982 - RNA, 3822 nt, Artificial Sequence
  SARS-CoV-2/Hong Kong/case42_VM20002493/2020__EPI_ISL_414527 spike protein CDS human (1-1273)
auguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucgccaucagcguuacuaccgaaauucuucccgugucuaugacaaagacuuccgucgauuguaccauguauauaugcggcgacucaacggaguguaguaaucuguugcuccaauacggaucuuuuugcacacagcugaacagagcauuaaccggcaucgcgguggagcaggauaaaaauacucaggaaguuuucgcucaagugaagcagauuuauaaaacaccgccuaucaaggacuuugggggauucaacuuuucgcagauucugccagaucccuccaaaccuucuaagaggagcuucaucgaggaccuacucuuuaauaagguaacccuggccgaugcagguuucauaaaacaauacggcgacugucuuggggauaucgccgcucgugacuugauuugcgcccagaaguucaacggacugacuguccugcccccacucuuaaccgaugaaaugaucgcacaguauacaucagcucugcuugccggcacgauuaccagugguuggacuuuuggggcgggcgccgcuuugcagaucccuuucgcaaugcaaauggccuaccgguuuaauggaauaggcgugacacagaacgugcucuaugagaaucagaaacugauugcuaaccaguucaacuccgccaucgggaagauucaagacucucuaagcuccaccgcaucagcgcugggaaaacuccaggacgucguuaaucagaacgcccaggcucugaauacacuugugaagcaauugagcaguaacuuuggcgccaucucuuccguacugaaugauauauuaagccgacucgacaagguggaagcagagguccagaucgauagacugauuacugguaggcuucagucgcugcaaaccuacgugacgcagcaguugauccgcgcugccgagauucgggcaucagccaaccucgcugcgacaaaaaugucugaaugcguucuggggcagaguaagagaguggacuucuguggaaaaggcuaccaccuaauguccuuuccccaaagcgccccacauggugucguguuccugcacguuaccuaugugccggcacaggagaagaauuuuacuaccgcuccugccaucugccacgauggcaaagcccauuuccccagggaaggggucuuuguaucuaacggaacacacugguucgugacucagcgcaauuuuuacgagccacagauaauuaccacagacaacacguucguuagcggcaauugugauguggucaucgggaucgugaacaauaccguauaugacccccuccaaccugagcuggauuccuucaaggaggaacuugacaaauacuuuaagaaccauacuucaccagauguggacuugggagauauuaguggcaucaaugcuagcgucguuaacauucagaaggaaauagaccgacugaaugagguggccaaaaacuuaaacgaaucucucaucgaccugcaggagcuugguaaguaugagcaguacauuaaauggcccugguauaucuggcugggguucauugcaggacuaaucgcgauagugauggucacaaucaugcucugcuguaugaccuccugcuguucaugccugaagggcuguugcaguugugguagcugcugcaaauuugaugaagacgauuccgagccuguguugaagggcguuaagcugcacuacacuuga

SEQ ID NO: 11983 - RNA, 3822 nt, Artificial Sequence
  SARS-CoV-2/USA/CruiseA-23/2020__EPI_ISL_414482 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaagucaagcagggcaauuuuaaaaaccucagagaguucguuuuuaagaacauugaugguuacuucaaaaucuacaguaagcacaccccaauaaauuuagugagggaccugccccagggguuuagcgcucuugagccuuugguagaucugccaaucggaauuaacaucacacgguuccagacucuacucgcccugcaucgcucuuaucuuaccccgggcgacuccucaagcggcuggacagcaggggccgcugcauacuaugugggauaccugcaacccagaaccuuuuugcucaaauauaaugaaaacgguacgauuacugaugccgucgacugcgcucuggauccuuuaagugagacaaaguguacccugaagucuuucacuguggaaaaaggcaucuaccagacauccaauuuuaggguucagccaaccgagagcauagugcgguuccccaacauuacgaaucucugcccuuuuggggaggucuucaacgccacccgcuucgcgucgguguaugcauggaaucgaaagagaaucucuaacuguguagccgacuacuccguucuuuacaauucagcuaguuuuagcacauucaaaugcuauggaguguccccaacuaagcugaacgacuuguguuuuaccaaugucuacgccgauucuuucgugauuaggggcgacgaaguccggcagaucgcacccggucaaacagggaaaaucgcugauuauaacuacaagcuaccggacgauuuuacuggaugcgugauugccuggaauagcaacaaccuggacucaaaaguuggcggcaauuauaacuaccucuaucgucuguuccgcaagaguaaucuuaagccuuuugagagagauauauccaccgaaaucuaccaggcggggagcacacccuguaacggaguggaggguuucaauugcuacuuuccacugcagucuuauggcuuccaaccuaccaacgggguaggauaccagcccuauagggucgugguuuugucauuugaacuccugcacgccccagcaacugugugcggccccaaaaagaguacgaauuuagucaaaaacaagugugugaauuucaacuuuaauggucugacagggaccggcguacuaacugagagcaacaaaaaguuccucccuuuccagcaguuuggacgggacauugcugauaccacagacgccgugcgagauccacaaacccuggagauccuugacauaacuccgugcuccuucggcgggguuucugucauuacacccggaacgaauaccucgaaccagguggcuguguuguaccaggacgucaauuguacugaaguuccuguggccauccacgcagaucagcugacaccaaccuggcgcguguauagcacagguuccaacguauuucaaacuagagccggcugccucaucggggcugagcaugucaacaauucauacgaaugugacauucccaucggagcgggcauuugcgcaaguuaucagacccagacgaacucuccuaggcgggcccgcagcguggcuucccagucaauaaucgccuacaccaugagccugggugcagaaaauucuguugccuacuccaacaauaguauugcuaucccaacaaacuucacuaucagcgugaccacagaaauucuucccgucucuaugacuaagaccuccguggauuguacgauguauauaugcggggacucaacagaguguaguaaucuguugcuccaauacggcagcuuuugcacccagcugaacagagccuuaacuggaaucgcaguugagcaggauaaaaauacacaggaaguguucgcgcaaguaaagcagauuuauaaaaccccgccuaucaaggacuuuggcggguucaacuuuucgcagauucugccagaucccuccaaaccuucuaagaggagcuucaucgaggaccuacucuuuaauaaggucacucuggcugaugccggauucauaaaacaauacggugacugucuuggcgauaucgcagcccgugacuugauuugcgcucagaaguucaacgggcugaccgugcugcccccacucuuaacagaugaaaugaucgcccaguauacgucagcacugcuugcuggaaccauuacgaguggcuggacauuuggugccggggcggccuugcagaucccuuucgcuaugcaaauggcauaccgguuuaauggcauaggagugacccagaacguccucuaugagaaucagaaacugauugccaaccaguucaacuccgcuaucggcaagauucaagacucucuaagcuccacagccucagcacuggggaaacuccaggacguugugaaucagaacgcgcaggcccugaauacucuuguaaagcaauugagcaguaacuuuggagcuaucucuuccgugcugaaugauauauuaagccgacucgacaaggucgaagccgaggugcagaucgauagacugauuaccggcaggcuucagucgcugcaaacguacguuacacagcaguugauccgcgcagcugagauucgggccucagcaaaccucgccgcuaccaaaaugucugaaugcgugcugggucagaguaagagagucgacuucugugggaaaggauaccaccuaauguccuuuccccaaagcgcgccacauggcgugguuuuccugcacgugacuuaugucccggcccaggagaagaauuuuaccacagcuccugcaaucugccacgaugguaaagcccauuuccccagggaaggcguauuugugucuaacgggacucacugguucguuacccagcgcaauuuuuacgagccacagauaauuacaacggacaacaccuucgugagcggaaauugugaugucgugaucggcaucguaaacaauacuguguaugacccccuccaaccugagcuggauuccuucaaggaagaacuugacaaauacuuuaagaaccauacaucaccagaugucgacuugggggauauuaguggaaucaaugccagcguugugaacauucagaaggaaauagaccgacugaaugagguggcuaaaaacuuaaacgaaucucucaucgaccugcaggagcuuggcaaguaugagcaguacauuaaauggcccugguauaucuggcuggguuucauugcagggcuaaucgccauagucauggugaccaucaugcucugcuguaugacuuccugcuguucaugccugaagggauguugcaguuguggcagcugcugcaaauuugaugaagacgauuccgagccuguuuugaaggguguaaagcugcacuacacauga

SEQ ID NO: 11984 - RNA, 3822 nt, Artificial Sequence
  SARS-CoV-2/Hong Kong/case85_VM20002868/2020__EPI_ISL_414519 spike protein CDS human (1-1273)
auguucguguuucugguccucguuccccuugugagcucccagugcguaaaccugaccacaagaacucaauugccuccagccuacacuaauucuuucaccaggggcguguauuacccggacaaggucuuucggucaaguguguuacacagcacacaggaucuguuccuacccuuuuucuccaacguuacuugguuucaugcuauccacgugucugggaccaauggaacaaaacgcuucgacaacccuguccucccauuuaaugaugguguguauuucgcaucgaccgagaagucaaacauuauacgaggcuggaucuuugggacuacacuggacagcaaaacccagagucuucugauuguaaauaacgccacgaauguugugaucaaggucugugaguuccaguuuugcaacgaucccuucuugggaguguacuaucauaaaaauaacaaguccuggauggagucugaguuccguguguacagcuccgcgaauaacuguacuuuugaauaugucucacaaccuuuccucauggaccuggaaggcaagcaggguaauuuuaaaaaccugagagaguucguuuuuaagaacauugauggguacuucaaaaucuacaguaagcacaccccaauaaaucucgugagggacuuaccccagggauuuagcgcucuggagccucuuguagauuugccaaucggcauuaacaucacacgguuccagacucugcuagcccuccaucgcucuuaucugaccccgggcgacuccucaagcggguggacagcaggagccgcugcauacuauguggguuaccuucaacccagaaccuuucuguugaaauauaaugaaaacggcacgauuacugaugccgucgacugcgcucucgauccucugagugagacaaaguguaccuuaaagucuuucacuguggaaaaagggaucuaccagacauccaauuuuaggguucagccaaccgagagcauagugcgguuccccaacauuacgaaucugugcccuuuuggagaggucuucaacgccacccgcuucgcgucgguguaugcauggaaucgaaagagaaucucuaacuguguagccgacuacuccguucucuacaauucagcuaguuuuagcacauucaaaugcuauggcguguccccaacuaaacuuaacgaccuguguuuuaccaaugucuacgccgauucuuucgugauuaggggugacgaaguccggcagaucgcacccgggcaaacaggaaagaucgcugauuauaacuacaaguugccggacgauuuuacuggcugcgugauugccuggaauagcaacaaccuagacucaaaaguuggcgggaauuauaacuaccuguaucgucucuuccgcaagaguaaucugaagccuuuugagagagauauauccaccgaaaucuaccaggcgggaagcacacccuguaacgguguggagggcuucaauugcuacuuuccacuucagucuuauggguuccaaccuaccaacggaguaggcuaccagcccuauagggucgugguucugucauuugaauugcuccacgccccagcaacugugugcggucccaaaaagaguacgaaucuggucaaaaacaagugugugaauuucaacuuuaauggguuaacaggcaccggaguacugacugagagcaacaaaaaguuccuaccuuuccagcaguuuggccgggacauugcugauaccacagacgccgugcgagauccacaaacccucgagauccuggacauaacuccgugcuccuucgggggaguuucugucauuacacccgguacgaauaccucgaaccagguggcugugcuuuaccaggacgucaauuguacugaaguuccuguggccauccacgcagaucaguugacaccaaccuggcgcguguauagcacaggcuccaacguauuucaaacuagagccgggugccugaucggagcugagcaugucaacaauucauacgaaugugacauucccaucggcgcggguauuugcgcaaguuaucagacccagacgaacucuccuaggcgggcccgcagcguggcuucccagucaauaaucgccuacaccaugagccucggggcagaaaauucuguugccuacuccaacaauaguauugcuaucccaacaaacuucacuaucagcgugaccacagaaauucugcccgucucuaugacuaagaccuccguggauuguacgauguauauaugcggcgacucaacagaguguaguaaucuucuguugcaauacggcagcuuuugcacccagcucaacagagcccugacuggaaucgcaguugagcaggauaaaaauacacaggaaguguucgcgcaaguaaagcagauuuauaaaaccccgccuaucaaggacuuugggggauucaacuuuucgcagauuuuaccagaucccuccaaaccuucuaagaggagcuucaucgaggaccugcuauuuaauaaggucacucucgcugaugccgguuucauaaaacaauacggcgacugucugggggauaucgcagcccgugaccuuauuugcgcucagaaguucaacggauugaccgugcugcccccacuccugacagaugaaaugaucgcccaguauacgucagcauuacuggcuggcaccauuacgagugguuggacauuuggggccggcgcggcccuucagaucccuuucgcuaugcaaauggcauaccgguuuaauggaauaggcgugacccagaacgucuuguaugagaaucagaaacucauugccaaccaguucaacuccgcuaucgggaagauucaagacucucugagcuccacagccucagcacuaggaaaacugcaggacguugugaaucagaacgcgcaggcccucaauacucugguaaagcaacuuagcaguaacuuuggcgcuaucucuuccguguugaaugauauacugagccgauuagacaaggucgaagccgaggugcagaucgauagacucauuaccgguaggcugcagucgcuucaaacguacguuacacagcagcugauccgcgcagcugagauucgggccucagcaaacuuggccgcuaccaaaaugucugaaugcgugcucgggcagaguaagagagucgacuucuguggaaaaggcuaccaccugauguccuuuccccaaagcgcgccacauggugugguuuuccuacacgugacuuaugucccggcccaggagaagaauuuuaccacagcuccugcaaucugccacgauggcaaagcccauuuccccagggaagggguauuugugucuaacggaacucacugguucguuacccagcgcaauuuuuacgagccacagauaauuacaacggacaacaccuucgugagcggcaauugugaugucgugaucgggaucguaaacaauacuguguaugacccccugcaaccugagcucgauuccuucaaggaggaacuggacaaauacuuuaagaaccauacaucaccagaugucgaccuuggagauauuaguggcaucaaugccagcguugugaacauucagaaggaaauagaccgauugaaugagguggcuaaaaaccugaacgaaucuuuaaucgaccuccaggagcuggguaaguaugagcaguacauuaaauggcccugguauaucuggcuuggguucauugcaggacugaucgccauagucauggugaccaucaugcuaugcuguaugacuuccugcuguucaugccucaagggcuguugcaguugugguagcugcugcaaauuugaugaagacgauuccgagccuguucugaagggcguaaaguugcacuacacauga

SEQ ID NO: 11985 - RNA, 3822 nt, Artificial Sequence
  SARS-CoV-2/England/200990660/2020__EPI_ISL_414523 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguaugacuuccugcuguucaugccugaaggguuguugcaguuguggcagcugcugcaaauuugacgaagaugacuccgaguuggugcugaaggggguuaaguuacacuacacauga

SEQ ID NO: 11986 - RNA, 3822 nt, Artificial Sequence
  SARS-CoV-2/Australia/NSW09/2020__EPI_ISL_413595 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccuacccccacuguuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucucagcuuuacagccuccgcacugggaaaacuccaggacgucguuaaucagaacgcgcaggcccugaauacucuugugaagcaauugucaagcaacuucggcgcuaucaguucuguacugaaugauauauuaucccgacucgacaagguggaagccgagguccagaucgauagacugauuaccgguaggcuucagagccugcaaacguacgugacacagcaguugauccgcgcagcugagauucgggccucggcaaaccucgccgcuaccaaaaugucagaaugcguucuggggcagucuaagagaguggacuuuuguggaaaaggcuaccaccuaaugaguuucccccaauccgcgccacauggugucguguuucugcacguuacuuaugugccggcccaggagaagaauuucaccacagcuccugcaaucugccacgauggcaaagcccauuuucccagggaaggggucuucguaagcaacggaacucacugguuugugacccagcgcaauuucuacgagccacagauaauuacaacggacaacaccuucguuucuggcaauugugauguggucaucgggaucgugaacaauacuguauaugacccccuccaaccugagcuggauagcuuuaaggaggaacuugacaaauacuucaagaaccauacauccccagauguggacuugggagauauuucaggcaucaaugccagugucguuaacauucagaaggaaauagaccgacugaaugagguggcuaaaaacuuaaacgaaagccucaucgaccugcaggagcuugguaaguaugagcaguacauuaaauggcccugguauaucuggcugggguuuauugcaggacuaaucgccauagugauggucaccaucaugcucugcuguaugacuucuugcuguuccugccugaagggcuguugcucaugugguaguugcugcaaauucgaugaagacgauagcgagccuguguugaagggcguuaagcugcacuacacauga

SEQ ID NO: 11987 - RNA, 3822 nt, Artificial Sequence
  SARS-CoV-2/Australia/NSW10/2020__EPI_ISL_413596 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggauuccuucaaggaggaacuugacaaauacuuuaagaaccauacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguaugagcaguacauuaaauggcccugguauaucuggcugggguucauugcaggacuaaucgccauagugauggucaccaucaugcucugcuguaugacuuccugcuguucaugccugaagggcuguugcaguugugguagcugcuuuaaauucgaugaagacgauuccgagccuguguugaagggcguuaagcugcacuacacauga

SEQ ID NO: 11988 - RNA, 3822 nt, Artificial Sequence
  SARS-CoV-2/Switzerland/1000477797/2020__EPI_ISL_413023 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaauaucuacaguaaacacaccccaauaaacuuaguuagggaccugccccagggauuuagcgcucuugagccuuugguggaucugccaaucggcauuaauaucacacgguuccagacucuacucgcccugcaucgcucuuaucuuaccccgggcgacuccucaagcggguggacagcaggagccgcugcauacuauguagguuaccugcaacccagaaccuuuuugcucaaguauaacgaaaauggcacgauuacugaugccguggacugcgcucuggauccuuuaagugagacaaaauguacccugaagucuuucacugucgaaaaggggaucuaccagacauccaacuuuagggugcagccaaccgagagcauaguucgguuccccaauauuacgaaccucugcccuuuuggagagguguucaaugccacccgcuucgcgucggucuaugcauggaaccgaaaaagaaucucuaauuguguggccgacuacuccguacuuuacaacucagcuaguuuuagcacauucaagugcuauggcguuuccccaacuaaacugaaugacuuguguuuuaccaacguguacgccgauucuuucgucauuaggggugacgaagugcggcagaucgcacccgggcaaacaggaaagaucgcugauuauaauuacaaacuaccggacgauuuuacuggcugcgucauugccuggaacagcaacaaucuggacucaaaggugggcgggaacuauaauuaccucuaucgucuguuccgcaaaaguaaccuuaagccuuuugagagagauauauccaccgaaaucuaccaggcgggaagcacacccuguaaugguguugagggcuucaacugcuacuuuccacugcagucuuauggguuccaaccuaccaauggagugggcuaccagcccuauaggguagucguguugucauuugaacuccugcacgccccagcaacuguuugcggucccaagaaaaguacgaacuuagugaagaauaaaugugucaacuucaauuuuaacgggcugacaggcaccggagugcuaacugagagcaauaagaaauuccucccuuuccagcaguuuggccgggacauugcugauaccacagacgccguacgagauccacaaacccuggagauccuugacauaacuccgugcuccuucgggggagugucuguuauuacacccgguacgaacaccucgaaucaggucgcuguguuguaccagggcgugaacuguacugaagucccuguugccauccacgcagaccagcugacaccaaccuggcgcguguauagcacaggguccaacguguuucaaacuagagccggaugccucaucggcgcugagcauguaaauaacucauacgaaugugauauucccaucggugcggggauuugcgcaaguuaucagacccagaccaauucuccuaggcgggcccgcagcgucgcuucccagucaauaaucgccuacacgaugagccugggcgcagagaacucuguggccuacuccaauaacaguauugcuaucccaacaaauuucacuaucagcguuaccacagaaauucuucccgugucuaugacuaagaccuccgucgacuguacgauguauauaugcggagauucaacagaguguaguaaccuguugcuccaauacggcagcuuuugcacccagcugaauagagccuuaacugggaucgcaguggagcaggacaagaacacacaggaaguuuucgcgcaagugaaacagauuuauaagaccccgccuaucaaagauuuuggagguuucaauuuuucgcagauucugccagaccccuccaagccuucuaaaaggagcuucaucgaggaucuacucuuuaacaagguaacucuggcugacgccggcuucauaaagcaauacggggauugucuuggagacaucgcagcccgugauuugauuugcgcucagaaauucaauggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaacggcauaggggugacccagaaugugcucuaugagaaccagaagcugauugccaaccaguucaauuccgcuaucggaaaaauucaagauucucuaagcuccacagccucagcacugggcaagcuccaggacgucguuaaccagaaugcgcaggcccugaacacucuugugaaacaauugagcaguaauuuuggugcuaucucuuccguacugaacgacauauuaagccgacucgauaagguggaagccgagguccagaucgacagacugauuaccgggaggcuucagucgcugcaaacguacgugacacagcaguugauccgcgcagcugagauucgggccucagcaaaucucgccgcuaccaagaugucugaaugcguucugggacagaguaaaagaguggauuucuguggcaaggguuaccaccuaauguccuuuccccaaagcgcgccacauggcgucguguuccugcacguuacuuaugugccggcccaggagaaaaacuuuaccacagcuccugcaaucugccacgacgggaaggcccauuuccccagggaaggagucuuuguaucuaauggcacucacugguucgugacccagcgcaacuuuuacgagccacagauaauuacaacggauaauaccuucguuagcgggaacugugacguggucaucggaaucgugaauaacacuguauaugauccccuccaaccugagcuggacuccuucaaagaagaacuugauaaguacuuuaaaaaucauacaucaccagacguggauuugggcgacauuagugguaucaacgccagcgucguuaauauucagaaggaaauagaucgacugaacgagguggcuaagaacuuaaaugaaucucucaucgaccugcaggagcuugggaaauaugagcaguacauuaaguggcccugguauaucuggcugggauucauugcaggccuaaucgccauagugauggucaccaucaugcucugcuguaugacuuccugcuguucaugccugaaagguuguugcaguuguggcagcugcugcaaguuugacgaagaugacuccgagccuguguugaaagggguuaagcugcacuacacauga

SEQ ID NO: 11989 - RNA, 3822 nt, Artificial Sequence
  SARS-CoV-2/Belgium/BA-02291/2020__EPI_ISL_415159 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcagaaguaaucuuaagccuuuugagagggauauauccaccgaaaucuaccaggcgggaagcacacccuguaacgguguugagggcuucaauugcuacuuuccacugcagucuuauggguuccaaccuaccaacggagugggcuaccagcccuaucggguagucguguugucauuugaacuccugccagcccccgcaacuguuugcgguccuaagaaaaguacgaauuuagugaagaacaaaugugucaauuucaacuuuaaugggcugacaggcaccggagugcuaacugagagcaacaagaaauuccucccauuccagcaguuuggccgagacauugcugauaccacagacgccguacgcgauccgcaaacccuggagauccuugacauaacucccugcuccuucgggggagugucuguuauuacaccugguacgaauaccucgaaccaggucgcuguguuguaccagggcgugaauuguacugaagucccaguugccauccacgcagaccagcugacacccaccuggagaguguauagcacaggguccaacguguuucaaacuagggccggaugccucaucggcgcugagcacguaaacaauucauacgaaugugauauuccuaucggugcggggauuugcgcaaguuaucagacccagacgaacucuccacggcgcgccagaagcgucgcuucccagucaauaaucgccuacaccaugagccugggcgcagaaaauucuguggccuacuccaacaauaguauugcuauccccacaaacuucacuaucagcguuaccacagaaauucuuccggugucuaugacuaagaccuccgucgacuguacgauguauauaugcggagauucaacagaguguaguaaucuguugcuccaauacggcagcuuuugcacccagcugaacagggccuuaacugggaucgcaguggagcaggacaagaauacacaggaaguuuucgcgcaagugaaacagauuuauaagaccccuccaaucaaagauuuuggagguuucaacuuuucgcagauucugcccgacccuuccaagcccucuaaacguagcuucaucgaggaucuacucuuuaauaagguaacucuggcugacgccggcuucauaaagcaauacggggauugucuuggagacaucgcagcccgggauuugauuugcgcucagaaauucaacggccugaccguccucccaccucuguuaacagacgaaaugaucgcccaguauacgucagcacugcuugcugguaccauuacgaguggguggacauuuggcgccggagcggccuugcagauccccuucgcuaugcaaauggcauaccgauuuaauggcauaggggugacccagaacgugcucuaugagaaucagaagcugauugccaaccaguucaacuccgcuaucggaaaaauucaagauucucuaagcuccgccgcaccagcgcugggcaagcuccaggacgucguuaaucagaacgcccaggcucugaauacacuugugaaacaauugucaagcaacuuuggugccaucaguucuguacugaaugacauauuauccagacucgauaagguggaagcagagguccagaucgacaggcugauuacugggcgccuucagagccugcaaaccuacgugacgcagcaguugauccgggcugccgagauuagagcaucggccaaccucgcugcgacaaagaugucagaaugcguucugggacagucuaaaaggguggauuucuguggcaaggguuaccaucuaaugaguuuuccgcaauccgccccucacggcgucguguuccugcauguuaccuaugugcccgcacaggagaaaaauuuuacuaccgcuccagccaucugccacgacgggaaggcccacuucccccgcgaaggagucuuuguaagcaacggcacacauugguucgugacucagcgaaauuuuuacgagccucagauaauuaccacagauaacacguucguuucugggaauugugacguggucaucggaaucgugaacaauaccguauaugauccacuccaacccgagcuggacagcuucaaagaagaacuugauaaguacuuuaaaaaccacacuuccccugacguggauuugggcgacauuucagguaucaaugcuagugucguuaacauucagaaggaaauagaucggcugaaugagguggcaaagaacuuaaacgaaagccucaucgaccugcaggagcuugggaaauaugagcaguacauuaaguggccgugguauaucuggcugggauucauugccggccuaaucgcgauagugauggucacaaucaugcucugcuguaugaccucuugcuguuccugccugaaagguuguugcucauguggcaguugcugcaaguuugacgaagaugacagcgagccaguguugaaagggguuaagcugcauuacacuuga

SEQ ID NO: 11990 - RNA, 3822 nt, Artificial Sequence
  SARS-CoV-2/USA/WA8-UW5/2020__EPI_ISL_413486 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugaguacguaaacaauucauaugaaugugacauucccaucggcgcggguauuugcgcaaguuaccagacccagacgaacucuccuaggcgggcccgcagcgucgcuucccagucaauaaucgccuacaccaugagccugggggcagaaaauucuguggccuauuccaacaauaguauugcuaucccaacaaacuucacuaucagcguuaccacagaaauucuucccgugucuaugacuaagaccuccgucgauuguacgauguacauaugcggcgacucaacagaguguaguaaucuguugcuccaauauggcagcuuuugcacccagcugaacagagccuuaacuggaaucgcaguggagcaggauaaaaauacacaggaaguuuucgcgcaagugaagcagauuuacaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauauggcgacugucuuggggauaucgcagcccgugacuugauuugcgcucagaaguucaacggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaauggaauaggcgugacccagaacgugcucuacgagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaucaucuaauguccuuuccccaaagcgcgccacacggugucguguuccugcauguuacuuacgugccggcccaggagaagaauuuuaccacagcuccugcaaucugccacgauggcaaagcccacuuccccagggaaggggucuuuguaucuaacggaacucauugguucgugacccagcgcaauuuuuaugagccacagauaauuacaacggacaacaccuucguuagcggcaauugugauguggucaucgggaucgugaacaauacuguauacgacccccuccaaccugagcuggauuccuucaaggaggaacuugacaaauauuuuaagaaccacacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcauuacacauga

SEQ ID NO: 11991 - RNA, 3822 nt, Artificial Sequence
  SARS-CoV-2/England/20102000506/2020__EPI_ISL_415147 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggguauugucuuggagauaucgcagcccgugacuugauuugcgcucagaaguucaacggccugaccguccugcccccacucuuaacagaugaaaugaucgcccaguacacgucagcacugcuugcugguaccauuacgaguggguggacauuuggcgccggagcggccuugcagaucccuuucgcuaugcaaauggcauaucgguuuaauggcauaggggugacccagaacgugcucuacgagaaucagaaacugauugccaaccaguucaacuccgcuaucggaaagauucaagacucucuaagcuccacagccucagcacugggcaaacuccaggaugucguuaaucagaacgcgcaggcccugaauacucuugugaagcaauugagcaguaacuuuggugcuaucucuuccguacugaaugacauauuaagccgacucgacaagguggaagccgagguccagaucgauagacugauuaccgggaggcuucagucgcugcaaacguacgugacacagcaguugauccgcgcagcugagauucgggccucagcaaaccucgccgcuaccaaaaugucugaaugcguucugggacagaguaagagaguggacuucuguggcaaagguuaucaccuaauguccuuuccccaaagcgcgccacauggcgucguguuccugcacguuacuuacgugccggcccaggagaagaauuuuaccacagcuccugcaaucugccacgaugggaaagcccauuuccccagggaaggagucuuuguaucuaacggcacucacugguucgugacccagcgcaauuuuuaugagccacagauaauuacaacggacaacaccuucguuagcgggaauugugauguggucaucggaaucgugaacaauacuguauacgacccccuccaaccugagcuggauuccuucaaggaagaacuugacaaauauuuuaagaaccauacaucaccagauguggacuugggcgauauuagugguaucaaugccagcgucguuaacauucagaaggaaauagaccgacugaaugagguggcuaaaaacuuaaacgaaucucucaucgaucugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagacgauuccgagccuguguugaaggggguuaagcugcacuacacauga

SEQ ID NO: 11992 - RNA, 3822 nt, Artificial Sequence
  SARS-CoV-2/Belgium/VAG-03013/2020__EPI_ISL_415155 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccacugcacugggcaaacuccaggacgucguuaaucagaacgcgcaggcccugaauacccuugugaagcaauugucaagcaacuuuggugcuaucaguucuguacugaaugacauauuaucccgacucgauaagguggaagccgagguccagaucgacagacugauuacggggaggcuucagagccugcaaacauacgugacccagcaguugauccgcgcagcugagauucgggccucggcaaaccucgccgcuacuaaaaugucagaaugcguucugggacagucuaagagaguggauuucuguggcaaagguuaccaccuaaugaguuuuccccaauccgcgccacauggcgucguguuccugcacguuaccuaugugccggcccaggagaagaauuuuacaacugcuccugcaaucugccacgacgggaaagcccauuuccccagggaaggagucuuuguaagcaacggcacccacugguucgugacacagcgcaauuuuuacgagccacagauaauuacgaccgauaacacuuucguuucugggaauugugacguggucaucggaaucgugaacaauacaguauaugauccccuccaaccugagcuggacagcuucaaggaagaacuugauaaauacuuuaagaaccauaccuccccagacguggauuugggcgacauuucagguaucaaugccagugucguuaacauucagaaggaaauagaucgacugaaugagguggcuaaaaacuuaaacgaaagccucaucgaccugcaggagcuugggaaguaugagcaguacauuaaauggcccugguauaucuggcugggauucauugcaggccuaaucgccauagugauggucacuaucaugcucugcuguaugacaucuugcuguuccugccugaaggguuguugcucauguggcaguugcugcaaauuugacgaagaugacagcgagccuguguugaaggggguuaagcugcacuacaccuga

SEQ ID NO: 11993 - RNA, 3822 nt, Artificial Sequence
  SARS-CoV-2/Belgium/BC-03016/2020__EPI_ISL_415157 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagcccccgcacugggcaaacuccaggacgucguuaaucagaacgcgcaggcccugaauacucuugugaagcaauugucaagcaacuuuggugcuaucaguucuguacugaaugacauauuaucccgacucgauaagguggaagccgagguccagaucgacagacugauuaccgggaggcuucagagccugcaaacguacgugacacagcaguugauccgcgcagcugagauucgggccucggcaaaccucgccgcuaccaaaaugucagaaugcguucugggacagucuaagagaguggauuucuguggcaaagguuaccaccuaaugaguuuuccacaauccgcgccgcauggcgucguguuccugcacguuacuuaugugccugcccaggagaagaauuuuaccacagcacccgcuaucugccacgacgggaaagcccauuucccaagggaaggagucuuuguaagcaacggcacucacugguucgugacccagcgcaauuuuuacgagccccagauaauuacaacggauaacaccuucguuucugggaauugugacguggucaucggaaucgugaacaauacuguauaugauccucuccaaccagagcuggacagcuucaaggaagaacuugauaaauacuuuaagaaccauacaucccccgacguggauuugggcgacauuucagguaucaaugccagugucguuaacauucagaaggaaauagaucgacugaaugagguggcuaaaaacuuaaacgaaagccucaucgaccugcaggagcuugggaaguaugagcaguacauuaaauggccuugguauaucuggcugggauucauugcaggccuaaucgccauagugauggucaccaucaugcucugcuguaugacuucuugcuguuccugccugaaggguuguugcucauguggcaguugcugcaaauuugacgaagaugacagcgagccgguguugaaggggguuaagcugcacuacacauga

SEQ ID NO: 11994 - RNA, 3822 nt, Artificial Sequence
  SARS-CoV-2/Germany/BavPat3/2020__EPI_ISL_414521 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacagcaaguuuucgcacaggugaagcagauuuauaaaaccccgccuaucaaggacuuugggggauucaacuuuucgcaaauucugccagaucccuccaaaccuucuaagaggagcuucaucgaagaccuacucuuuaauaagguaacucuggcugaugccgguuucauaaaacaguacggcgacugucuuggggauaucgcagcccgugacuugauuugcgcucagaaguucaacggacugaccguccugcccccacucuuaacagaugagaugaucgcccaguauacgucagcacugcuugcuggcaccauuacgagugguuggacauuuggggccggcgcggccuugcaaaucccuuucgcuaugcagauggcauaccgguuuaauggaauaggcgugacccagaacgugcucuaugaaaaucagaaacugauugccaaccaauucaacuccgcuaucgggaagauucaggacucucuaagcuccacagccucagcacugggaaaacuccaggacgucguuaaucagaacgcgcaagcccugaauacucuugugaagcaguugagcaguaacuuuggcgcuaucucuuccguacugaaugauauauuaagccgacucgacaagguggaggccgaaguccagaucgauagacugauuaccgguaggcuucaaucgcugcagacguacgugacacagcaguugauccgcgcagcugagauucgggccucagcaaaccucgccgcuaccaaaaugucugagugcguucuggggcaaaguaagagaguggacuucuguggaaaaggcuaccaccuaauguccuuuccccagagcgcgccacauggugucguguuccugcacguuacuuaugugccggcccaggaaaagaauuuuaccacagcgccugcuaucugccacgauggcaaagcccauuuccccagggagggggucuuuguaucuaacggaacucacugguucgugacccagcgcaauuuuuacgaaccacaaauaauuacaacggacaacaccuucguuagcggcaauugugauguggucaucgggaucgugaacaauacuguauaugacccccuccagccugagcuggauuccuucaaggaggaacuugacaaauacuuuaagaaccauacaucaccagauguggacuugggagauauuaguggcaucaaugccagcgucguuaacauucagaaggagauagaccgacugaaugaaguggcuaaaaacuuaaacgagucucucaucgaccugcaggaacuugguaaguaugagcaauacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugaugaggacgauuccgaaccuguguugaagggcguuaagcugcacuacacauga

SEQ ID NO: 11995 - RNA, 3822 nt, Artificial Sequence
  SARS-CoV-2/France/HF1805/2020__EPI_ISL_414628 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggagugguaaacaauacuguguaugauccccuccaaccugagcuggacuccuucaaggaagaacuugauaaauacuuuaagaaccauacaucaccagacgucgauuugggcgacaucagugguauuaaugccagcguugugaacauccagaaggaaauugaucgacugaaugagguggcuaaaaacuuaaacgaaucucucauagaccugcaggagcuugggaaguaugagcaguacaucaaauggcccugguauauuuggcugggauucaucgcaggccuaauugccaucgucauggugaccauaaugcucugcuguaugacuuccugcuguucaugccugaaggguuguugcaguuguggcagcugcugcaaauuugacgaagaugacuccgagccuguuuugaaggggguaaagcugcacuacacauga

SEQ ID NO: 11996 - RNA, 3822 nt, Artificial Sequence
  SARS-CoV-2/Netherlands/ZuidHolland_9/2020__EPI_ISL_414445 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcguccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacauga

SEQ ID NO: 11997 - RNA, 3822 nt, Artificial Sequence
  SARS-CoV-2/Finland/FIN03032020A/2020__EPI_ISL_413602 spike protein CDS human (1-1273)
auguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauuagcuggaacucaaauaaccuggacaguaaagugggcgggaauuauaacuaccucuaucgucuguuccgcaaguccaaucuuaagccuuuugagagagauauaagcaccgaaaucuaccaggccggaucuacacccuguaacgguguugagggcuucaauugcuacuuuccacugcagucauauggguuccaaccuaccaacggagugggcuaccagcccuauaggguagucguguugaguuuugaacuccugcacgcgccagccacuguuugcggucccaaaaagagcacgaauuuagugaaaaacaagugugucaauuucaacuuuaaugggcugacaggcaccggagugcuaacugaguccaacaaaaaguuccucccuuuccagcaguuuggccgggacauugcagauaccacagacgcuguacgagauccacaaacccuggagauccuugacauaacuccgugcucuuucgggggagugucgguuauuacacccgguacgaauaccagcaaccaggucgccguguuguaccagggcgugaauuguacugaagucccuguugcuauccacgccgaccagcugacaccaaccuggcgcguguauuccacagggucaaacguguuucaaacuagagcaggaugccucaucggcgccgagcauguaaacaauaguuacgaaugugauauucccaucggugcugggauuugcgcgucuuaucagacccagacgaacagcccuaggcgggcacgcuccgucgccucacagagcauaaucgcuuacaccaugucucugggcgccgaaaauuccguggcauacaguaacaauagcauugccaucccaacaaacuucacuaucucuguuaccacagaaauucuucccguguccaugacuaagaccucagucgacuguacgauguauauaugcggagauaguacagaguguagcaaucuguugcuccaauacggcucguuuugcacccagcugaacagagcuuuaacugggaucgccguggagcaggacaaaaauacacaggaaguuuucgcacaagugaagcagauuuauaaaaccccgccuaucaaggauuuuggagguuucaacuuuucccagauucugccagaccccucuaaaccuagcaagaggucauucaucgaggaucuacucuuuaauaagguaacucuggcggacgcuggcuucauaaaacaauacggggauugucuuggagacaucgccgcacgugauuugauuugcgcccagaaguucaacggccugaccguccugcccccacucuuaacagacgaaaugaucgcucaguauacgagugcccugcuugcagguaccauuacuuccggguggacauuuggcgcuggagccgcguugcagaucccuuucgccaugcaaauggcuuaccgguuuaauggcauaggggugacccagaacgugcucuaugagaaucagaaacugauugcaaaccaguucaacucugccaucggaaagauucaagauagccuauccucaacagcuagcgcccugggcaaacuccaggacgucguuaaucagaacgcacaggcgcugaauacucuugugaagcaauugaguucuaacuuuggugccaucuccagcguacugaaugacauauuaucgcgacucgauaagguggaagcugagguccagaucgacagacugauuaccgggaggcuucagucacugcaaacguacgugacacagcaguugauccgcgccgcagagauucgggcuucugccaaccucgcagccaccaaaaugagugaaugcguucugggacaguccaagagaguggauuucuguggcaaagguuaccaccuaaugagcuuuccccaaucugcuccacauggcgucguguuccugcacguuacuuaugugccggcgcaggagaagaauuuuaccacagccccugcaaucugccacgacgggaaagcucauuuccccagggaaggagucuuuguaagcaacggcacucacugguucgugacccagcgcaauuuuuacgagccacagauaauuacaacggauaacaccuucguuuccgggaauugugacguggucaucggaaucgugaacaauacuguauaugauccccuccaaccugagcuggacucauucaaggaagaacuugauaaauacuuuaagaaccauacaaguccagacguggauuugggcgacauuagcgguaucaaugccucugucguuaacauucagaaggaaauagaucgacugaaugagguggccaaaaacuuaaacgaaucccucaucgaccugcaggagcuugggaaguaugagcaguacauuaaauggcccugguauaucuggcugggauucauugcuggccuaaucgcaauagugauggucaccaucaugcucugcuguaugacuucaugcuguaguugccugaaggguuguugcagcuguggcuccugcugcaaauuugacgaagaugacucugagccuguguugaaggggguuaagcugcacuacacauga

SEQ ID NO: 11998 - RNA, 3822 nt, Artificial Sequence
  SARS-CoV-2/France/GE1977/2020__EPI_ISL_414632 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuauuuagcacagccuccgcacugggcaaacuccaggacgucguuaaucagaacgcgcaggcccugaauacucuugugaagcaauugucaagcaacuucggugcuaucaguucuguacugaaugacauauuaucccgacucgauaagguggaagccgagguccagaucgacagacugauuaccgggaggcuucagagccugcaaacguacgugacacagcaguugauccgcgcagcugagauucgggccucggcaaaccucgccgcuaccaaaaugucagaaugcguucugggacagucuaagagaguggauuuuuguggcaaagguuaccaccuaaugaguuucccccaauccgcgccacauggcgucguguuucugcacguuacuuaugugccggcccaggagaagaauuucaccacagcuccugcaaucugccacgacgggaaagcccauuuucccagggaaggagucuucguaagcaacggcacucacugguuugugacccagcgcaauuucuacgagccacagauaauuacaacggauaacaccuucguuucugggaauugugacguggucaucggaaucgugaacaauacuguauaugauccccuccaaccugagcuggacagcuuuaaggaagaacuugauaaauacuucaagaaccauacauccccagacguggauuugggcgacauuucagguaucaaugccagugucguuaacauucagaaggaaauagaucgacugaaugagguggcuaaaaacuuaaacgaaagccucaucgaccugcaggagcuugggaaguaugagcaguacauuaaauggcccugguauaucuggcugggauuuauugcaggccuaaucgccauagugauggucaccaucaugcucugcuguaugacuucuugcuguuccugccugaaggguuguugcucauguggcaguugcugcaaauucgacgaagaugacagcgagccuguguugaaggggguuaagcugcacuacacauga

SEQ ID NO: 11999 - RNA, 3822 nt, Artificial Sequence
  SARS-CoV-2/Finland/FIN-313/2020__EPI_ISL_414641 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguucaaaacucuacucgcccugcaucgcucuuaucuuaccccgggcgacuccucaagcggguggacagcaggagccgcugcauacuauguagguuaccugcagcccagaaccuuuuugcucaaguauaaugaaaacggcacgauuacugaugccguggacugcgcucuggauccuuuaagugagacaaaguguacccugaaaucuuucacugucgaaaaggggaucuaccaaacauccaauuuuagggugcagccaaccgagagcauaguucgguuccccaacauuacgaaucucugcccuuuuggagagguguucaacgccacccgcuucgcgucggucuaugcauggaaucgaaaaagaaucucuaacuguguggccgacuacuccguacuuuacaauucagcuaguuuuagcacauucaagugcuauggcguuuccccaacuaaacugaacgacuuguguuuuaccaauguguacgccgauucuuucgucauuaggggugacgaagugcggcagaucgcacccgggcagacaggaaagaucgcugauuauaacuacaaacuaccggacgauuuuacuggcugcgucauugccuggaauagcaacaaccuggacucaaaggugggcgggaauuauaacuaccucuaucgucuguuccgcaagaguaaucuuaaaccuuuugagagagauauauccaccgaaaucuaccaagcgggaagcacacccuguaacgguguugagggcuucaauugcuacuuuccacugcagucuuauggguuccagccuaccaacggagugggcuaccaacccuauaggguagucguguugucauuugaacuccugcacgccccagcaacuguuugcggucccaagaaaaguacgaauuuagugaagaacaaaugugucaauuucaacuuuaaugggcugacaggcaccggagugcuaacugagagcaacaagaaguuccucccuuuccagcaguuuggccgggacauugcugauaccacagacgccguacgagauccacagacccuggagauccuugacauaacuccgugcuccuucgggggagugucuguuauuacacccgguacgaauaccucgaaccaagucgcuguguuguaccagggcgugaauuguacugaagucccuguugccauccacgcagaccagcugacaccaaccuggcgcguguauagcacaggguccaacguguuucagacuagagccggaugccucaucggcgcugagcauguaaacaauucauacgaaugugauauucccaucggugcggggauuugcgcaaguuaucaaacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaaaaccuccgucgacuguacgauguauauaugcggagauucaacagaguguaguaaucuguugcuccaguacggcagcuuuugcacccaacugaacagagccuuaacugggaucgcaguggagcaggacaagaauacacaggaaguuuucgcacaggugaaacaaauuuauaagaccccgccuaucaaagauuuuggagguuucaacuuuucgcagauucugccagaccccuccaagccuucuaagaggagcuucaucgaggaucuacucuuuaauaaaguaacucuggcugacgccggcuucauaaagcaguacggggauugucuuggagacaucgcagcccgugauuugauuugcgcucaaaaauucaacggccugaccguccugcccccacucuuaacagacgaaaugaucgcccaguauacgucagcacugcuugcugguaccauuacgaguggguggacauuuggcgccggagcggccuugcagaucccuuucgcuaugcagauggcauaccgguuuaauggcauaggggugacccaaaacgugcucuaugagaaucagaagcugauugccaaccaguucaacuccgcuaucggaaaaauucaggauucucuaagcuccacagccucagcacugggcaagcuccaagacgucguuaaucagaacgcgcaggcccugaauacucuugugaagcaguugagcaguaacuuuggugcuaucucuuccguacugaaugacauauuaagccgacucgauaaaguggaagccgagguccaaaucgacagacugauuaccgggaggcuucagucgcugcagacguacgugacacaacaguugauccgcgcagcugagauucgggccucagcaaaccucgccgcuaccaagaugucugaaugcguucugggacagaguaaaagaguggauuucuguggcaaggguuaccaccuaauguccuuuccccagagcgcgccacauggcgucguguuccugcacguuacuuaugugccggcccaagagaaaaauuuuaccacagcgccugcuaucugccacgacgggaaggcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccagccugagcuggacuccuucaaagaagaacuugauaaguacuuuaagaaccauacaucaccagacguggauuugggcgacauuagugguaucaaugccagcgucguuaacauucaaaaagaaauagaucgacugaaugagguggcuaagaacuuaaacgaaucucucaucgaccugcaggagcuugggaaauaugagcaguacauuaaguggcccugguauaucuggcugggauucauugcaggccuaaucgccauagugauggucaccaucaugcucugcuguaugacuuccugcuguucaugccugaaagguuguugcaguuguggcagcugcugcaaguuugacgaagaugacuccgagccuguguugaaggggguuaaacugcacuacacauga

SEQ ID NO: 12000 - RNA, 3822 nt, Artificial Sequence
  SARS-CoV-2/Netherlands/ZuidHolland_2/2020__EPI_ISL_414556 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcacuggagcaggacaaaaauacacaggaaguguucgcgcaaguuaagcagauuuauaaaaccccgccuaucaaggauuuuggagguuucaacuuuucgcagauucuaccagaccccuccaaaccuucuaagaggagcuucaucgaggaucuccuguuuaauaaggugacucuugcugacgccggcuucauaaaacaauacggggauuguuugggagacaucgcagcccgugaucugauuugcgcucagaaguucaacggccucaccguacugcccccauuacugacagacgaaaugaucgcccaguauacgucagcacuuuuggcugguaccauuacgaguggguggacauuuggcgccggagcggcccuccagaucccuuucgcuaugcaaauggcauaccgguuuaauggcauaggggucacccagaacgugcuguaugagaaucagaaacuaauugccaaccaguucaacuccgcuaucggaaagauucaagauucucugagcuccacagccucagcacucggcaaacugcaggacguggucaaucagaacgcgcaggcccuuaauacuuugguuaagcaacugagcaguaacuuuggugcuaucucuuccguguuaaaugacauacucagccgacuggauaagguagaagccgaggugcagaucgacagacuuauuaccgggaggcugcagucguugcaaacguacgucacacagcagcucauccgcgcagcugagauucgggccucagcaaaccuggccgcuaccaaaaugucugaaugcgugcuaggacagaguaagagaguugauuucuguggcaaagguuaccaccugauguccuuuccccaaagcgcgccacauggcguggucuuccuccacgugacuuauguuccggcccaggagaagaauuuuaccacagcuccugcaaucugccacgacgggaaagcccauuuccccagggaaggaguguuugucucuaacggcacucacugguucguaacccagcgcaauuuuuacgagccacagauaauuacaacggauaacaccuucgugagcgggaauugugacguugugaucggaaucgucaacaauacuguguaugauccccugcaaccugagcuugacuccuucaaggaagaguuggauaaauacuuuaagaaccauacaucaccagacguagaucugggcgacauuagugguaucaaugccagcguggucaacauucagaaggaaauagaucgauuaaaugagguugcuaaaaaccucaacgaaucucugaucgaccuucaggagcuggggaaguaugagcaguacauuaaauggcccugguauaucuggcuaggauucauugcaggccucaucgccauagugauggugaccaucaugcugugcuguaugacuuccugcuguucaugcuugaaggguuguugcaguuguggcagcugcugcaaauuugacgaagaugacuccgagccuguccugaagggggugaaguuacacuacacauga

SEQ ID NO: 12001 - RNA, 3822 nt, Artificial Sequence
  SARS-CoV-2/USA/WA-UW31/2020__EPI_ISL_414618 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacggugccgagggcuucaauugcuacuuuccacugcagucuuauggguuccaaccuaccaacggaguuggcuaccagcccuauagggugguagucuugucauuugaacuccugcacgcaccagcuacugugugcggucccaaaaagaguacgaauuuaguuaaaaacaagugugugaauuucaacuuuaaugggcugacaggcaccggaguccuaacugagagcaacaaaaaguuccucccuuuccagcaguuuggccgggacauugccgauaccacagacgcugugcgagauccacaaacccuggagauccuugacauaacuccgugcuccuucgggggaguaucugugauuacacccgguacgaauaccucgaaccagguugccgucuuguaccaggacgugaauuguacugaagugccugucgcaauccacgccgaucagcugacaccaaccuggcgcguuuauagcacaggcuccaacguguuucaaacuagagcugggugccucaucggagcggagcaugugaacaauucauacgaaugugacauucccaucggcgcagguauuugcgccaguuaucagacccagacgaacucuccuaggcgggcucgcagcguagccucccagucaauaaucgcauacaccaugagccugggggccgaaaauucugucgcuuacuccaacaauaguauugccaucccaacaaacuucacuaucagcgugaccacagaaauucuucccguuucuaugacuaagaccuccguggauuguacgauguauauaugcggcgacucaacagaguguaguaaucuguugcuccaauacggcagcuuuugcacccagcugaacagagcauuaacuggaaucgcggucgagcaggauaaaaauacacaggaaguguucgcucaaguuaagcagauuuauaaaaccccgccuaucaaggacuuugggggauucaacuuuucgcagauucugccagaucccuccaaaccuucuaagaggagcuucaucgaggaccuacucuuuaauaaggugacucuggccgaugcagguuucauaaaacaauacggcgacugucuuggggauaucgccgcucgugacuugauuugcgcccagaaguucaacggacugaccguacugcccccacucuuaacagaugaaaugaucgcacaguauacgucagcucugcuugccggcaccauuacgagugguuggacauuuggggcgggcgccgcuuugcagaucccuuucgcaaugcaaauggccuaccgguuuaauggaauaggcgucacccagaacgugcucuaugagaaucagaaacugauugcuaaccaguucaacuccgccaucgggaagauucaagacucucuaagcuccacagcaucagcgcugggaaaacuccaggacguggucaaucagaacgcccaggcucugaauacucuuguuaagcaauugagcaguaacuuuggcgccaucucuuccgugcugaaugauauauuaagccgacucgacaagguagaagcagaggugcagaucgauagacugauuaccgguaggcuucagucgcugcaaacguacgucacacagcaguugauccgcgcugccgagauucgggcaucagccaaccucgcugcgaccaaaaugucugaaugcgugcuggggcagaguaagagaguugacuucuguggaaaaggcuaccaccuaauguccuuuccccaaagcgccccacaugguguggucuuccugcacgugacuuauguuccggcacaggagaagaauuuuaccacagcuccugccaucugccacgauggcaaagcccauuuccccagggaagggguguuugucucuaacggaacucacugguucguaacccagcgcaauuuuuacgagccacagauaauuacaacggacaacaccuucgugagcggcaauugugauguugugaucgggaucgucaacaauacuguguaugacccccuccaaccugagcuggauuccuucaaggaggaacuugacaaauacuuuaagaaccauacaucaccagauguagacuugggagauauuaguggcaucaaugcuagcguggucaacauucagaaggaaauagaccgacugaaugagguugccaaaaacuuaaacgaaucucucaucgaccugcaggagcuugguaaguaugagcaguacauuaaauggcccugguauaucuggcugggguucauugcaggacuaaucgcgauagugauggugaccaucaugcucugcuguaugacuuccugcuguucaugccugaagggcuguugcaguugugguagcugcugcaaauuugaugaagacgauuccgagccugucuugaagggcgugaagcugcacuacacauga

SEQ ID NO: 12002 - RNA, 3822 nt, Artificial Sequence
  SARS-CoV-2/South Korea/SNU01/2020__EPI_ISL_411929 spike protein CDS human (1-1273)
auguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuugggcucuugagccuuugguggaucugccaaucggcauuaacaucacacgguuccagacucuacucgcccugcaucgcagcuaucuuaccccgggcgacucuuccucaggguggacagcaggagccgcugcauacuauguagguuaccugcaacccagaaccuuuuugcucaaauauaaugaaaacggcacgauuacugaugccguggacugcgcucuggauccuuuaagcgagacaaaguguacccugaagaguuucacugucgaaaaagggaucuaccagacaucuaauuuuagggugcagccaaccgaguccauaguucgguuccccaacauuacgaaucucugcccuuuuggagagguguucaacgccacccgcuucgcgagcgucuaugcauggaaucgaaagagaaucucgaacuguguggccgacuacucuguacuuuacaauuccgcuucauuuaguacauucaaaugcuauggcguuagcccaacuaagcugaacgacuuguguuuuaccaauguguacgccgauuccuucgucauuaggggugacgaagugcggcagaucgcacccgggcaaacaggaaaaaucgcugauuauaacuacaagcuaccggacgauuuuacuggcugcgucauugccuggaacucuaauaaccuggacagcaaagugggcgggaauuauaacuaccucuaucgucuguuccgcaagucaaaucuuaagccuuuugagagagauauaaguaccgaaaucuaccaggcgggauccacacccuguaacgguguugagggcuucaauugcuacuuuccacugcagagcuauggguuccaaccuaccaacggagugggcuaccagcccuauaggguagucguguugucuuuugaacuccugcacgccccagcaacuguuugcggucccaaaaagucaacgaauuuagugaaaaacaagugugucaauuucaacuuuaaugggcugacaggcaccggagugcuaacugagaguaacaaaaaguuccucccuuuccagcaguuuggccgggacauugcugauaccacagacgccguacgagauccacaaacccuggagauccuugacauaacuccgugcagcuucgggggaguguccguuauuacacccgguacgaauaccucuaaccaggucgcuguguuguaccaggacgugaauuguacugaagucccuguugccauccacgcagaucagcugacaccaaccuggcgcguguauucgacaggcagcaacguguuucaaacuagagccgggugccucaucggagcugagcauguaaacaauuccuacgaaugugacauucccaucggcgcggguauuugcgcaucauaucagacccagacgaacaguccuaggcgggcccgcucugucgcuagccaguccauaaucgccuacaccaugucacugggggcagagaauagcguggccuacucuaacaauuccauugcuaucccaacaaacuucacuaucaguguuaccacagaaauucuucccgugagcaugacuaagaccucugucgauuguacgauguauauaugcggcgacuccacagaguguucaaaucuguugcuccaauacggaaguuuuugcacccagcugaacagagccuuaacuggcaucgcaguggagcaggauaaaaauacacaggaaguuuucgcgcaagugaagcagauuuauaaaaccccgccuaucaaggacuuugggggauucaacuuuagccagauucugccagaucccucgaaaccuuccaagaggucuuucaucgaggaccuacucuuuaauaagguaacucuggcugaugccgguuucauaaaacaauacggcgacugucuuggggauaucgcagcccgugacuugauuugcgcucagaaguucaacggacugaccguccucccuccacuguuaacagaugaaaugaucgcccaguauacgagcgcacugcuugcuggcaccauuacuucagguuggacauuuggggccggcgcggccuugcagaucccuuucgcuaugcaaauggcauaccgguuuaauggaauaggcgugacccagaacgugcucuaugagaaucagaaacugauugccaaccaguucaacagugcuaucgggaagauucaagacucccuaucuagcacagccuccgcacugggaaaacuccaggacgucguuaaucagaacgcgcaggcccugaauacucuugugaagcaauugucaagcaacuuuggcgcuaucaguucuguacugaaugauauauuaucccgacucgacaagguggaagccgagguccagaucgauagacugauuaccgguaggcuucagagccugcaaacguacgugacacagcaguugauccgcgcagcugagauucgggccucggcaaaccucgccgcuaccaaaaugucagaaugcguucuggggcagucuaagagaguggacuucuguggaaaaggcuaccaccuaaugaguuuuccccaauccgcgccacauggugucguguuccugcacguuacuuaugugccggcccaggagaagaauuuuaccacagcacccgcuaucugccacgauggcaaagcccauuuccccagggaaggggucuuuguaagcaacggaacucacugguucgugacccagcgcaauuuuuacgagccacagauaauuacaacggacaacaccuucguuucuggcaauugugauguggucaucgggaucgugaacaauacuguauaugacccccuccaaccugagcuggauagcuucaaggaagaacuugacaaauacuuuaagaaccauacauccccagauguggacuugggagauauuucaggcaucaaugccagugucguuaacauucagaaggaaauagaccgacugaaugagguggcuaaaaacuuaaacgaaagccucaucgaccugcaggagcuugguaaguaugagcaguacauuaaauggcccugguauaucuggcugggguucauugcaggacuaaucgccauagugauggucaccaucaugcucugcuguaugacuucuugcuguuccugccugaagggcuguugcucaugugguaguugcugcaaauuugaugaagacgauagcgagccuguguugaagggcguuaagcugcacuacacauga

SEQ ID NO: 12003 - RNA, 3822 nt, Artificial Sequence
  SARS-CoV-2/China/WF0004/2020__EPI_ISL_413694 spike protein CDS human (1-1273)
auguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggacugagucugaguuccguguguacagcuccgcgaauaacuguaccuuugaguaugugucacaaccuuuccugauggaccuggaaggcaagcaggguaauuuuaaaaaccucagagaguucgucuuuaagaacauugauggguacuucaaaaucuacaguaagcacacaccaauaaauuuaguuagggaccugccccagggauuuagcgcucuugagccuuugguggaucugccaaucggcauuaacaucacucgguuccagacccuacucgcccugcaucgcucuuaucuuacaccgggcgacuccucaagcggguggaccgcaggagccgcugcauacuauguagguuaccugcaacccagaacguuuuugcucaaauauaaugaaaacggcacuauuacagaugccguggacugcgcucuggauccuuuaagugagaccaaguguacucugaagucuuucacagucgaaaaagggaucuaccagaccuccaauuuuagggugcagccaacggagagcauaguucgguuccccaacauuaccaaucucugcccuuuuggagagguguucaacgccacacgcuucgcgucggucuaugcauggaaucgaaagagaaucucuaacuguguggccgacuacuccguacuuuacaauucagcuaguuuuagcacuuucaaaugcuauggcguuuccccaaccaagcugaacgacuuguguuuuacaaauguguacgccgauucuuucgucauuaggggugacgaagugcggcagaucgcacccgggcaaacuggaaaaaucgcugauuauaacuacaagcuaccggacgauuuuaccggcugcgucauugccuggaauagcaacaaccuggacucaaaagugggcgggaauuauaacuaccucuaucgucuguuccgcaagaguaaucuuaagccuuuugagagagauauauccacagaaaucuaccaggcgggaagcacccccuguaacgguguugagggcuucaauugcuacuuuccacugcagucuuauggguuccaaccuacuaacggagugggcuaccagcccuauaggguagucguguugucauuugaacuccugcacgccccagcaacgguuugcggucccaaaaagaguacaaauuuagugaaaaacaagugugucaauuucaacuuuaaugggcugaccggcacuggagugcuaaccgagagcaacaaaaaguuccucccuuuccagcaguuuggccgggacauugcugauacaaccgacgccguacgagauccacaaacucuggagauccuugacauaacaccgugcuccuucgggggagugucuguuauuacgcccgguaccaauacuucgaaccaggucgcuguguuguaccaggacgugaauuguacagaagucccuguugccauccacgcagaucagcugaccccaacauggcgcguguauagcacuggcuccaacguguuucaaaccagagccgggugccucaucggagcugagcauguaaacaauucauacgaaugugacauucccaucggcgcggguauuugcgcaaguuaucagacgcagaccaacucuccuaggcgggcccgcagcgucgcuucccagucaauaaucgccuacacaaugagccugggggcagaaaauucuguggccuacuccaacaauaguauugcuaucccaacuaacuucaccaucagcguuacaacugaaauucuucccgugucuaugaccaagacguccgucgauuguacaauguauauaugcggcgacucaaccgaguguaguaaucuguugcuccaauacggaucuuuuugcacucagcugaacagagccuuaacaggcaucgcaguggagcaggauaaaaauacccaggaaguuuucgcgcaagugaagcagauuuauaaaacuccgccuaucaaggacuuugggggauucaacuuuucgcagauucugccagaucccuccaaaccuucuaagaggagcuucaucgaggaccuacucuuuaauaagguaacccuggcugaugccgguuucauaaaacaauacggcgacugucuuggggauaucgcagcccgugacuugauuugcgcucagaaguucaacggacugacaguccugcccccacucuuaacggaugaaaugaucgcccaguauaccucagcacugcuugcuggcacuauuacaagugguuggaccuuuggggccggcgcggccuugcagaucccuuucgcuaugcaaauggcauaccgguuuaauggaauaggcgugacacagaacgugcucuaugagaaucagaaacugauugccaaccaguucaacuccgcuaucgggaagauucaagacucucuaagcuccacugccucagcacugggaaaacuccaggacgucguuaaucagaacgcgcaggcccugaauacccuugugaagcaauugagcaguaacuuuggcgcuaucucuuccguacugaaugauauauuaagccgacucgacaagguggaagccgagguccagaucgauagacugauuacggguaggcuucagucgcugcaaacauacgugacccagcaguugauccgcgcagcugagauucgggccucagcaaaccucgccgcuacuaaaaugucugaaugcguucuggggcagaguaagagauucgacuuuuguggaaaaggcuaccaccuaauguccuucccccaaagcgcgccacaugguguggucuuucugcacgugaccuauguuccggcccaggagaagaauuucacaacugcuccugcaaucugccacgauggcaaagcccauuuucccagggaagggguguucgucucuaacggaacccacugguuuguaacacagcgcaauuucuacgagccacagauaauuacgaccgacaacacuuucgugagcggcaauugugauguugugaucgggaucgucaacaauacaguguaugacccccuccaaccugagcuggauuccuuuaaggaagaacuugacaaauacuucaagaaccauaccucaccagauguagacuugggagauauuaguggcaucaaugccagcguggucaacauucagaaggaaauagaccgacugaaugagguugcuaaaaacuuaaacgaaucucucaucgaccugcaggagcuugguaaguaugagcaguacauuaaauggcccugguauaucuggcugggguuuauugcaggacuaaucgccauagugauggugacuaucaugcucugcuguaugacauccugcuguucaugccugaagggcuguugcaguugugguagcugcugcaaauucgaugaagacgauuccgagccugucuugaagggcgugaagcugcacuacaccuga

SEQ ID NO: 12004 - RNA, 3822 nt, Artificial Sequence
  SARS-CoV-2/China/WF0028/2020__EPI_ISL_413791 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggaauccuucaaggaggaacuugauaaauacuuuaagaaccauacaucaccagacguggauuugggagacauuaguggcaucaaugccagcgucguuaacauucagaaggagauagaucgacugaaugaaguggcuaaaaacuuaaacgagucucucaucgaccugcaggagcuugguaaguaugaacaguacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugacgaggaugacuccgaaccuguguugaagggcguuaagcugcacuacacauga

SEQ ID NO: 12005 - RNA, 3822 nt, Artificial Sequence
  SARS-CoV-2/2019-nCoV/USA-CruiseA-18/2020__MT159716.1 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaacugcguguguacagcuccgcgaauaacuguacuuucgaguaugugucacaaccuuuucugauggaccucgaaggcaagcaggguaauuucaaaaacuuaagagaguuugucuucaagaacauugauggguacuuuaaaaucuacaguaagcacaccccaauaaaucugguuagggaccuuccccagggauucagcgcuuuggagccucugguggaucuaccaaucggcauuaacaucacacgguuucagacucuccuggcccuucaucgcucuuaucugaccccgggcgacuccucaagcggguggacagcaggagccgcugcauacuauguagguuacuugcaacccagaaccuuccuccugaaauauaaugaaaacggcacgauuacugaugccguggacugcgcuuuagauccucugagugagacaaaguguacccucaagucuuuuacugucgaaaaagggaucuaccagacauccaauuucagggugcagccaaccgagagcauaguucgguuucccaacauuacgaaucuuugcccuuucggagagguguuuaacgccacccgcuucgcgucggucuaugcauggaaucgaaagagaaucucuaacuguguggccgacuacuccguacuguacaauucagcuaguuucagcacauuuaaaugcuauggcguuuccccaacuaaguugaacgaccuauguuucaccaauguguacgccgauucuuuugucauuaggggugacgaagugcggcagaucgcacccgggcaaacaggaaaaaucgcugauuauaacuacaagcugccggacgauuucacuggcugcgucauugccuggaauagcaacaaccucgacucaaaagugggcgggaauuauaacuaccuguaucgucuuuuucgcaagaguaaucugaagccuuucgagagagauauauccaccgaaaucuaccaggcgggaagcacacccuguaacgguguugagggcuuuaauugcuacuucccauugcagucuuauggguuucaaccuaccaacggagugggcuaccagcccuauaggguagucgugcucucauucgaacuguuacacgccccagcaacuguuugcggucccaaaaagaguacgaaucuggugaaaaacaagugugucaauuuuaacuucaaugggcuaacaggcaccggagugcucacugagagcaacaaaaaguuucugccuuuccagcaguucggccgggacauugcugauaccacagacgccguacgagauccacaaacccuugagaucuuggacauaacuccgugcuccuuugggggagugucuguuauuacacccgguacgaauaccucgaaccaggucgcugugcuguaccaggacgugaauuguacugaagucccuguugccauccacgcagaucagcucacaccaaccuggcgcguguauagcacaggcuccaacguguuccaaacuagagccgggugccugaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccuuggggcagaaaauucuguggccuacuccaacaauaguauugcuaucccaacaaacuuuacuaucagcguuaccacagaaauucugcccgugucuaugacuaagaccuccgucgauuguacgauguauauaugcggcgacucaacagaguguaguaauuugcuccugcaauacggcagcuucugcacccaguuaaacagagcccugacuggaaucgcaguggagcaggauaaaaauacacaggaaguuuuugcgcaagugaagcagauuuauaaaaccccgccuaucaaggacuucgggggauuuaacuucucgcagauucuaccagaucccuccaaaccuucuaagaggagcuuuaucgaggaccuccuguucaauaagguaacucuugcugaugccgguuuuauaaaacaauacggcgacuguuugggggauaucgcagcccgugaccugauuugcgcucagaaguucaacggacucaccguccugcccccauuacugacagaugaaaugaucgcccaguauacgucagcacuuuuggcuggcaccauuacgagugguuggacauucggggccggcgcggcccuccagaucccuuuugcuaugcaaauggcauaccgguucaauggaauaggcgugacccagaacgugcuguaugagaaucagaaacuaauugccaaccaguuuaacuccgcuaucgggaagauucaagacucucugagcuccacagccucagcacucggaaaacugcaggacgucguuaaucagaacgcgcaggcccuuaauacuuuggugaagcaacugagcaguaacuucggcgcuaucucuuccguauuaaaugauauacucagccgacuggacaagguggaagccgagguccagaucgauagacuuauuaccgguaggcugcagucguugcaaacguacgugacacagcagcucauccgcgcagcugagauucgggccucagcaaaccuggccgcuaccaaaaugucugaaugcguucuagggcagaguaagagaguggacuuuuguggaaaaggcuaccaccugauguccuucccccaaagcgcgccacauggugucguguuucuccacguuacuuaugugccggcccaggagaagaauuucaccacagcuccugcaaucugccacgauggcaaagcccauuuucccagggaaggggucuucguaucuaacggaacucacugguuugugacccagcgcaauuucuacgagccacagauaauuacaacggacaacaccuuuguuagcggcaauugugauguggucaucgggaucgugaacaauacuguauaugacccccugcaaccugagcuugauuccuucaaggaagaguuggacaaauacuucaagaaccauacaucaccagauguggaccugggagauauuaguggcaucaaugccagcgucguuaacauucagaaggaaauagaccgauuaaaugagguggcuaaaaaccucaacgaaucucugaucgaccuucaggagcuggguaaguaugagcaguacauuaaauggcccugguauaucuggcuaggguuuauugcaggacucaucgccauagugauggucaccaucaugcugugcuguaugacuuccugcuguucaugcuugaagggcuguugcaguugugguagcugcugcaaauucgaugaagacgauuccgagccugugcugaagggcguuaaguuacacuacacauga

SEQ ID NO: 12006 - RNA, 3822 nt, Artificial Sequence
  SARS-CoV-2/SARS-CoV-2/Yunnan-01/human/2020/CHN__MT049951.1 spike protein CDS human (1-1273)
auguucguguuucugguccuccuuccccugguuagcucccagugcgugaacuugaccacaagaacucaauuaccuccagccaauacgaacucuuucaccaggggcguauacuauccggacaagguguuucggucaaguguccugcacagcacacaggaucuauuccuccccuuuuucuccaaugugacuugguuucaugcuauccacguuucugggaccaacggaacaaaacgcuucgacaauccugugcugccauuuaacgauggugucuacuucgcaucgaccgagaagucaaauauuauacgaggcuggaucuuugggacuacacuugacagcaaaacccagagucuguugauugugaacaaugccacgaacguaguuaucaaggugugugaguuccaguuuugcaaugaucccuuccucggagucuauuaccauaaaaacaauaaguccuggauggagucugaguuccguguguauagcuccgcgaacaauuguacuuuugaauacgugucacaaccuuuccugauggaccuggaaggcaagcaggguaacuuuaaaaaccucagagaguucgucuuuaagaauauugauggguauuucaaaaucuacaguaagcacaccccaauaaacuuaguuagggaccugccccagggauuuagcgcucuugagccuuugguggaucugccaaucggcauuaauaucacacgguuccagacucuacucgcccugcaucgcucuuaccuuaccccgggcgacuccucaagcggguggacagcaggagccgcugcauauuacguagguuaucugcaacccagaaccuuuuugcucaaauacaacgaaaauggcacgauuacugaugccguggacugcgcucuggauccuuuaagugagacaaaguguacccugaagucuuucacugucgaaaaagggaucuaucagacauccaacuuuagggugcagccaaccgagagcauaguucgguuccccaauauuacgaaccucugcccuuuuggagagguguucaaugccacccgcuucgcgucggucuacgcauggaaccgaaagagaaucucuaauuguguggccgacuauuccguacuuuacaacucagcuaguuuuagcacauucaaaugcuacggcguuuccccaacuaagcugaaugacuuguguuuuaccaacguguaugccgauucuuucgucauuaggggugacgaagugcggcagaucgcacccgggcaaacaggaaaaaucgcugauuacaauuauaagcuaccggacgauuuuacuggcugcgucauugccuggaacagcaacaaucuggacucaaaagugggcgggaacuacaauuaucucuaccgucuguuccgcaagaguaaccuuaagccuuuugagagagauauauccaccgaaaucuaucaggcgggaagcacacccuguaaugguguugagggcuucaacugcuacuuuccacugcagucuuacggguuccaaccuaccaauggagugggcuaucagcccuacaggguagucguguugucauuugaacuccugcacgccccagcaacuguuugcggucccaaaaagaguacgaacuuagugaaaaauaagugugucaacuucaauuuuaacgggcugacaggcaccggagugcuaacugagagcaauaaaaaguuccucccuuuccagcaguuuggccgggacauugcugauaccacagacgccguacgagauccacaaacccuggagauccuugacauaacuccgugcuccuucgggggagugucuguuauuacacccgguacgaacaccucgaaucaggucgcuguguuguaucaggacgugaacuguacugaagucccuguugccauccacgcagaucagcugacaccaaccuggcgcguguacagcacaggcuccaacguguuucaaacuagagccgggugccucaucggagcugagcauguaaauaacucauaugaaugugacauucccaucggcgcggguauuugcgcaaguuaccagacccagacuaauucuccuaggcgggcccgcagcgucgcuucccagucaauaaucgccuauaccaugagccugggggcagagaacucuguggccuacuccaauaacaguauugcuaucccaacaaauuucacuaucagcguuaccacagaaauucuucccgugucuaugacuaagaccuccgucgauuguacgauguacauaugcggcgacucaacagaguguaguaaccuguugcuccaauauggcagcuuuugcacccagcugaauagagccuuaacuggaaucgcaguggagcaggauaaaaacacacaggaaguuuucgcgcaagugaagcagauuuacaaaaccccgccuaucaaggacuuugggggauucaauuuuucgcagauucugccagaucccuccaaaccuucuaagaggagcuucaucgaggaccuacucuuuaacaagguaacucuggcugaugccgguuucauaaaacaauauggcgacugucuuggggauaucgcagcccgugacuugauuugcgcucagaaguucaauggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaacggaauaggcgugacccagaaugugcucuacgagaaccagaaacugauugccaaccaguucaauuccgcuaucgggaagauucaagacucucuaagcuccacagccucagcacugggaaaacuccaggacgucguuaaccagaaugcgcaggcccugaacacucuugugaagcaauugagcaguaauuuuggcgcuaucucuuccguacugaacgauauauuaagccgacucgacaagguggaagccgagguccagaucgauagacugauuaccgguaggcuucagucgcugcaaacguaugugacacagcaguugauccgcgcagcugagauucgggccucagcaaaucucgccgcuaccaaaaugucugaaugcguucuggggcagaguaagagaguggacuucuguggaaaaggcuaccaccuaauguccuuuccccaaagcgcgccacauggugucguguuccugcacguuacuuacgugccggcccaggagaagaacuuuaccacagcuccugcaaucugccacgauggcaaagcccauuuccccagggaaggggucuuuguaucuaauggaacucacugguucgugacccagcgcaacuuuuaugagccacagauaauuacaacggacaauaccuucguuagcggcaacugugauguggucaucgggaucgugaauaacacuguauacgacccccuccaaccugagcuggauuccuucaaggaagaacuugacaaauauuuuaagaaucauacaucaccagauguggacuugggagauauuaguggcaucaacgccagcgucguuaauauucagaaggaaauagaccgacugaacgagguggcuaaaaacuuaaaugaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcacuauacauga

SEQ ID NO: 12007 - RNA, 3822 nt, Artificial Sequence
  SARS-CoV-2/USA/WA-UW292/2020__EPI_ISL_418077 spike protein CDS human (1-1273)
auguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgagcucuacacccuguaacggaguugaggguuucaauugcuacuuuccacugcagucauauggcuuccaaccuaccaacggggugggauaccagcccuauaggguagucguguugaguuuugaacuccugcacgccccagcaacuguuugcggccccaaaaagagcacgaauuuagugaaaaacaagugugucaauuucaacuuuaauggucugacagggaccggcgugcuaacugaguccaacaaaaaguuccucccuuuccagcaguuuggacgggacauugcugauaccacagacgccguacgagauccacaaacccuggagauccuugacauaacuccgugcucuuucggcggggugucgguuauuacacccggaacgaauaccagcaaccaggucgcuguguuguaccaggacgugaauuguacugaagucccuguugccauccacgcagaucagcugacaccaaccuggcgcguguauuccacagguucaaacguguuucaaacuagagccggcugccucaucggggcugagcauguaaacaauaguuacgaaugugacauucccaucggagcgggcauuugcgcaucuuaucagacccagacgaacagcccuaggcgggcccgcuccgucgcuucacagagcauaaucgccuacaccaugucucugggugcagaaaauuccguggccuacaguaacaauagcauugcuaucccaacaaacuucacuaucucuguuaccacagaaauucuucccguguccaugacuaagaccucagucgauuguacgauguauauaugcggggacaguacagaguguagcaaucuguugcuccaauacggcucguuuugcacccagcugaacagagccuuaacuggaaucgcaguggagcaggauaaaaauacacaggaaguuuucgcgcaagugaagcagauuuauaaaaccccgccuaucaaggacuuuggcggguucaacuuuucccagauucugccagaucccucuaaaccuagcaagaggucauucaucgaggaccuacucuuuaauaagguaacucuggcugaugccggauucauaaaacaauacggugacugucuuggcgauaucgcagcccgugacuugauuugcgcucagaaguucaacgggcugaccguccucccuccacuguuaacagaugaaaugaucgcccaguauacgagugcacugcuugcuggaaccauuacuuccggcuggacauuuggugccggggcggccuugcagaucccuuucgcuaugcaaauggcauaccgguuuaauggcauaggagugacccagaacgugcucuaugagaaucagaaacugauugccaaccaguucaacucugcuaucggcaagauucaagacagccuauccucaacagccagcgcacuggggaaacuccaggacgucguuaaucagaacgcgcaggcccugaauacucuugugaagcaauugaguucuaacuuuggagcuaucuccagcguacugaaugauauauuaucgcgacucgacaagguggaagccgagguccagaucgauagacugauuaccggcaggcuucagucacugcaaacguacgugacacagcaguugauccgcgcagcugagauucgggccucugcaaaccucgccgcuaccaaaaugagugaaugcguucugggucaguccaagagaguggacuucugugggaaaggauaccaccuaaugagcuuuccccaaucugcgccacauggcgucguguuccugcacguuacuuaugugccggcccaggagaagaauuuuaccacagcacccgcuaucugccacgaugguaaagcccauuuccccagggaaggcgucuuuguaagcaacgggacucacugguucgugacccagcgcaauuuuuacgagccacagauaauuacaacggacaacaccuucguuuccggaaauugugauguggucaucggcaucgugaacaauacuguauaugacccccuccaaccugagcuggauucauucaaggaagaacuugacaaauacuuuaagaaccauacaaguccagauguggacuugggggauauuagcggaaucaaugccucugucguuaacauucagaaggaaauagaccgacugaaugagguggcuaaaaacuuaaacgaaucccucaucgaccugcaggagcuuggcaaguaugagcaguacauuaaauggcccugguauaucuggcuggguuucauugcagggcuaaucgccauagugauggucaccaucaugcucugcuguaugacuucaugcuguaguugccugaagggauguugcagcuguggcuccugcugcaaauuugaugaagacgauucugagccuguguugaaggguguuaagcugcacuacacauga

SEQ ID NO: 12008 - RNA, 3822 nt, Artificial Sequence
  SARS-CoV-2/Iceland/192/2020__EPI_ISL_417819 spike protein CDS human (1-1273)
auguucguguuuuucguccugcucccccuuguuagcucccagugcgugaaccugaccacaagaacucaauugccuccagccuacacuaauucuuuuaccaggggcguauauuacccggacaagguguuccggucaagugucuuacacagcacacaggaucuguuucuacccuucuuuuccaacgugacuugguuccaugcuauccacguuucugggaccaauggaacaaaacgcuuugacaacccugugcucccauucaaugauggugucuauuuugcaucgaccgagaagucaaacauuauacgaggcuggaucuucgggacuacacuggacagcaaaacccagagucuucugauugugaauaacgccacgaauguaguuaucaaggugugugaauuucaguucugcaacgaucccuucuugggagucuacuaucauaaaaauaacaaguccuggauggagucugaauuucguguguacagcuccgcgaauaacuguacuuucgaguaugugucacaaccuuuucucauggaccuggaaggcaagcaggguaauuucaaaaaccugagagaguuugucuucaagaacauugauggguacuuuaaaaucuacaguaagcacaccccaauaaaucucguuagggacuuaccccagggauucagcgcucuggagccucuuguggauuugccaaucggcauuaacaucacacgguuucagacucugcuagcccuccaucgcucuuaucugaccccgggcgacuccucaagcggguggacagcaggagccgcugcauacuauguagguuaccuucaacccagaaccuuccuguugaaauauaaugaaaacggcacgauuacugaugccguggacugcgcucucgauccucugagugagacaaaguguaccuuaaagucuuuuacugucgaaaaagggaucuaccagacauccaauuucagggugcagccaaccgagagcauaguucgguuucccaacauuacgaaucugugcccuuucggagagguguucaacgccacccgcuuugcgucggucuaugcauggaaucgaaagagaaucucuaacuguguggccgacuacuccguacucuacaauucagcuaguuucagcacauuuaaaugcuauggcguuuccccaacuaaacuuaacgaccuguguuucaccaauguguacgccgauucuuuugucauuaggggugacgaagugcggcagaucgcacccgggcaaacaggaaagaucgcugauuauaacuacaaguugccggacgauuucacuggcugcgucauugccuggaauagcaacaaccuagacucaaaagugggcgggaauuauaacuaccuguaucgucucuuucgcaagaguaaucugaagccuuucgagagagauauauccaccgaaaucuaccaggcgggaagcacacccuguaacgguguugagggcuuuaauugcuacuucccacuucagucuuauggguuucaaccuaccaacggagugggcuaccagcccuauaggguagucgugcugucauucgaauugcuccacgccccagcaacuguuugcggucccaaaaagaguacgaaucuggugaaaaacaagugugucaauuuuaacuucaauggguuaacaggcaccggagugcugacugagagcaacaaaaaguuccuaccuuuucagcaguucggccgggacauugcugauaccacagacgccguacgagauccacaaacccucgagauccuggacauaacuccgugcuccuuugggggagugucuguuauuacacccgguacgaauaccucgaaccaggucgcugugcuuuaccagggcgugaauuguacugaagucccuguugccauccacgcagaccaguugacaccaaccuggcgcguguauagcacaggguccaacguguuccaaacuagagccggaugccugaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccucggcgcagaaaauucuguggccuacuccaacaauaguauugcuaucccaacaaacuuuacuaucagcguuaccacagaaauucugcccgugucuaugacuaagaccuccgucgacuguacgauguauauaugcggagauucaacagaguguaguaaucuucuguugcaauacggcagcuucugcacccagcucaacagagcccugacugggaucgcaguggagcaggacaaaaauacacaggaaguuuuugcgcaagugaagcagauuuauaaaaccccgccuaucaaggauuucggagguuuuaacuucucgcagauuuuaccagaccccuccaaaccuucuaagaggagcuuuaucgaggaucugcuauucaauaagguaacucucgcugacgccggcuucauaaaacaauacggggauugucugggagacaucgcagcccgugaucuuauuugcgcucagaaguuuaacggcuugaccguccugcccccacuccugacagacgaaaugaucgcccaguauacgucagcauuacuggcugguaccauuacgaguggguggacauucggcgccggagcggcccuucagaucccuuuugcuaugcaaauggcauaccgguucaauggcauaggggugacccagaacguguuguaugagaaucagaaacucauugccaaccaguuuaacuccgcuaucggaaagauucaagauucucugagcuccacagccucagcacuaggcaaacugcaggacgucguuaaucagaacgcgcaggcccucaauacucuggugaagcaacuuagcaguaacuucggugcuaucucuuccguauugaaugacauacugagccgauuagauaagguggaagccgagguccagaucgacagacucauuaccgggaggcugcagucgcuucaaacguacgugacacagcagcugauccgcgcagcugagauucgggccucagcaaacuuggccgcuaccaaaaugucugaaugcguucucggacagaguaagagaguggauuuuuguggcaaagguuaccaccugauguccuucccccaaagcgcgccacauggcgucguguuucuacacguuacuuaugugccggcccaggagaagaauuucaccacagcuccugcaaucugccacgacgggaaagcccauuuucccagggaaggagucuucguaucuaacggcacucacugguuugugacccagcgcaauuucuacgagccacagauaauuacaacggauaacaccuucguuagcgggaauugugacguggucaucggaaucgugaacaauacuguauaugauccccugcaaccugagcucgacuccuuuaaggaggagcuggauaaauacuucaagaaccauacaucaccagacguggaucuuggcgacauuagugguaucaaugccagcgucguuaacauucagaaggaaauagaucgauugaaugagguggcuaaaaaccugaacgaaucuuuaaucgaccuccaggagcuggggaaguaugagcaguacauuaaauggcccugguauaucuggcuuggauuuauugcaggccugaucgccauagugauggucaccaucaugcuaugcuguaugacuuccugcuguucaugccucaaggguuguugcaguuguggcagcugcugcaaauucgacgaagaugacuccgagccugugcugaaggggguuaaguugcacuacacauga

SEQ ID NO: 12009 - RNA, 3822 nt, Artificial Sequence
  SARS-CoV-2/Belgium/ULG-6939/2020__EPI_ISL_417020 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucugugguuuacuccaacaauaguauugccaucccaacaaacuucacuaucagcgugaccacagaaauucuucccgucucuaugacuaagaccuccguggacuguacgauguauauaugcggagauucaacagaguguaguaaucuguugcuccaauacggcagcuuuugcacccagcugaacagagcuuuaacugggaucgccguugagcaggacaaaaauacacaggaaguguucgcacaaguaaagcagauuuauaaaaccccgccuaucaaggauuuuggagguuucaacuuuucgcagauucugccagaccccuccaaaccuucuaagaggagcuucaucgaggaucuacucuuuaauaaggucacucuggcggacgcuggcuucauaaaacaauacggggauugucuuggagacaucgccgcacgugauuugauuugcgcccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacauga

SEQ ID NO: 12010 - RNA, 3822 nt, Artificial Sequence
  SARS-CoV-2/France/HF2496/2020__EPI_ISL_418231 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgucgcacgugauuugauuugcgcccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacauga

SEQ ID NO: 12011 - RNA, 3822 nt, Artificial Sequence
  SARS-CoV-2/USA/WA-UW291/2020__EPI_ISL_418076 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaauacucucuaagcuccacagccucagcacugggcaaacuccaggaugucguuaaucagaacgcgcaggcccugaauacucuugugaagcaauugagcaguaacuuuggugcuaucucuuccguacugaaugacauauuaagccgacucgacaagguggaagccgagguccagaucgauagacugauuaccgggaggcuucagucgcugcaaacguacgugacacagcaguugauccgcgcagcugagauucgggccucagcaaaccucgccgcuaccaaaaugucugaaugcguucugggacagaguaagagaguggacuucuguggcaaagguuaucaccuaauguccuuuccccaaagcgcgccacauggcgucguguuccugcacguuacuuacgugccggcccaggagaagaauuuuaccacagcuccugcaaucugccacgaugggaaagcccauuuccccagggaaggagucuuuguaucuaacggcacucacugguucgugacccagcgcaauuuuuaugagccacagauaauuacaacggacaacaccuucguuagcgggaauugugauguggucaucggaaucgugaacaauacuguauacgacccccuccaaccugagcuggauuccuucaaggaagaacuugacaaauauuuuaagaaccauacaucaccagauguggacuugggcgauauuagugguaucaaugccagcgucguuaacauucagaaggaaauagaccgacugaaugagguggcuaaaaacuuaaacgaaucucucaucgaucugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagacgauuccgagccuguguugaaggggguuaagcugcacuacacauga

SEQ ID NO: 12012 - RNA, 3822 nt, Artificial Sequence
  SARS-CoV-2/Portugal/PT0034/2020__EPI_ISL_418019 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguauuacuuccugcuguucaugccugaaggguuguugcaguuguggcagcugcugcaaauuugacgaagaugacuccgagccuguguugaaggggguuaagcugcacuacacauga

SEQ ID NO: 12013 - RNA, 3822 nt, Artificial Sequence
  SARS-CoV-2/Iceland/202/2020__EPI_ISL_417750 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggauuccuucaaggaggaacuugacaaauacuuuaagaaccauacaucaccagauguggacuugggagauauucccggcaucaaugccagugucguuaacauucagaaggaaauagaccgacugaaugagguggcuaaaaacuuaaacgaaagccucaucgaccugcaggagcuugguaaguaugagcaguacauuaaauggccuugguauaucuggcugggguucauugcaggacuaaucgccauagugauggucaccaucaugcucugcuguaugacuucuugcuguuccugccugaagggcuguugcucaugugguaguugcugcaaauuugaugaagacgauagcgagccgguguugaagggcguuaagcugcacuacacauga

SEQ ID NO: 12014 - RNA, 3822 nt, Artificial Sequence
  SARS-CoV-2/USA/WA-UW261/2020__EPI_ISL_418046 spike protein CDS human (1-1273)
auguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucacaucggucuaugcguggaaucgaaagagaaucucuaacuguguggcagacuacuccguacuuuacaauucagccaguuuuagcacuuucaaaugcuauggcguuuccccaaccaagcugaacgacuuguguuuuacaaauguguacgcugauucuuucgucauuaggggugacgaagugcggcagaucgcccccgggcaaacuggaaaaaucgcagauuauaacuacaagcuaccggacgauuuuaccggcugcgucauugcuuggaauagcaacaaccuggacucaaaagugggcgggaauuauaacuaccucuaucgucuguuccgcaagaguaaucuuaagccuuuugagagagauauauccacagaaaucuaccaggccggaagcacccccuguaacgguguugagggcuucaauugcuacuuuccacugcagucuuauggguuccaaccuacuaacggagugggcuaccagcccuauaggguagucguguugucauuugaacuccugcacgcgccagccacgguuugcggucccaaaaagaguacaaauuuagugaaaaacaagugugucaauuucaacuuuaaugggcugaccggcacuggagugcuaaccgagagcaacaaaaaguuccucccuuuccagcaguuuggccgggacauugcagauacaaccgacgcuguacgagauccacaaacucuggagauccuugacauaacaccgugcuccuucgggggagugucuguuauuacgcccgguaccaauacuucgaaccaggucgccguguuguaccaggacgugaauuguacagaagucccuguugcuauccacgccgaucagcugaccccaacauggcgcguguauagcacuggcuccaacguguuucaaaccagagcagggugccucaucggagccgagcauguaaacaauucauacgaaugugacauucccaucggcgcugguauuugcgcgaguuaucagacgcagaccaacucuccuaggcgggcacgcagcgucgccucccagucaauaaucgcuuacacaaugagccugggggccgaaaauucuguggcauacuccaacaauaguauugccaucccaacuaacuucaccaucagcguuacaacugaaauucuucccgugucuaugaccaagacguccgucgauuguacaauguauauaugcggcgacucaaccgaguguaguaaucuguugcuccaauacggaucuuuuugcacucagcugaacagagcuuuaacaggcaucgccguggagcaggauaaaaauacccaggaaguuuucgcacaagugaagcagauuuauaaaacuccgccuaucaaggacuuugggggauucaacuuuucgcagauucugccagaucccuccaaaccuucuaagaggagcuucaucgaggaccuacucuuuaauaagguaacccuggcggaugcugguuucauaaaacaauacggcgacugucuuggggauaucgccgcacgugacuugauuugcgcccagaaguucaacggacugacaguccugcccccacucuuaacggaugaaaugaucgcucaguauaccucagcccugcuugcaggcacuauuacaagugguuggaccuuuggggcuggcgccgcguugcagaucccuuucgccaugcaaauggcuuaccgguuuaauggaauaggcgugacacagaacgugcucuaugagaaucagaaacugauugcaaaccaguucaacuccgccaucgggaagauucaagacucucuaagcuccacugcuucagcccugggaaaacuccaggacgucguuaaucagaacgcacaggcgcugaauacccuugugaagcaauugagcaguaacuuuggcgccaucucuuccguacugaaugauauauuaagccgacucgacaagguggaagcugagguccagaucgauagacugauuacggguaggcuucagucgcugcaaacauacgugacccagcaguugauccgcgccgcagagauucgggcuucagccaaccucgcagccacuaaaaugucugaaugcguucuggggcagaguaagagaguggacuucuguggaaaaggcuaccaccuaauguccuuuccccaaagcgcuccacauggugucguguuccugcacguuaccuaugugccggcgcaggagaagaauuuuacaacugccccugcaaucugccacgauggcaaagcucauuuccccagggaaggggucuuuguaucuaacggaacccacugguucgugacacagcgcaauuuuuacgagccacagauaauuacgaccgacaacacuuucguuagcggcaauugugauguggucaucgggaucgugaacaauacaguauaugacccccuccaaccugagcuggauuccuucaaggaagaacuugacaaauacuuuaagaaccauaccucaccagauguggacuugggagauauuaguggcaucaaugccagcgucguuaacauucagaaggaaauagaccgacugaaugagguggccaaaaacuuaaacgaaucucucaucgaccugcaggagcuugguaaguaugagcaguacauuaaauggcccugguauaucuggcugggguucauugcuggacuaaucgcaauagugauggucacuaucaugcucugcuguaugacauccugcuguucaugccugaagggcuguugcaguugugguagcugcugcaaauuugaugaagacgauuccgagccuguguugaagggcguuaagcugcacuacaccuga

SEQ ID NO: 12015 - RNA, 3822 nt, Artificial Sequence
  SARS-CoV-2/Portugal/PT0035/2020__EPI_ISL_418020 spike protein CDS human (1-1273)
auguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggaucuuuuugcacccagcugaacagagccuuaacuggcaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucucagcacgugacuugauuugcgcccagaaguucaacggacugaccguccugcccccacucuuaacagaugaaaugaucgcucaguauacgagugcccugcuugcaggcaccauuacuuccgguuggacauuuggggcuggcgccgcguugcagaucccuuucgccaugcaaauggcuuaccgguuuaauggaauaggcgugacccagaacgugcucuaugagaaucagaaacugauugcaaaccaguucaacucugccaucgggaagauucaagacagccuauccucaacagcuagcgcccugggaaaacuccaggacgucguuaaucagaacgcacaggcgcugaauacucuugugaagcaauugaguucuaacuuuggcgccaucuccagcguacugaaugauauauuaucgcgacucgacaagguggaagcugagguccagaucgauagacugauuaccgguaggcuucagucacugcaaacguacgugacacagcaguugauccgcgccgcagagauucgggcuucugccaaccucgcagccaccaaaaugagugaaugcguucuggggcaguccaagagaguggacuucuguggaaaaggcuaccaccuaaugagcuuuccccaaucugcuccacauggugucguguuccugcacguuacuuaugugccggcgcaggagaagaauuuuaccacagccccugcaaucugccacgauggcaaagcucauuuccccagggaaggggucuuuguaagcaacggaacucacugguucgugacccagcgcaauuuuuacgagccacagauaauuacaacggacaacaccuucguuuccggcaauugugauguggucaucgggaucgugaacaauacuguauaugacccccuccaaccugagcuggauucauucaaggaagaacuugacaaauacuuuaagaaccauacaaguccagauguggacuugggagauauuagcggcaucaaugccucugucguuaacauucagaaggaaauagaccgacugaaugagguggccaaaaacuuaaacgaaucccucaucgaccugcaggagcuugguaaguaugagcaguacauuaaauggcccugguauaucuggcugggguucauugcuggacuaaucgcaauagugauggucaccaucaugcucugcuguaugacuucaugcuguaguugccugaagggcuguugcagcugugguuccugcugcaaauuugaugaagacgauucugagccuguguugaagggcguuaagcugcacuacacauga

SEQ ID NO: 12016 - RNA, 3822 nt, Artificial Sequence
  SARS-CoV-2/USA/NY-NYUMC7/2020__EPI_ISL_418192 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuaccaucacaaaaauaacaaguccuggauggagucugaguuccguguguauagcuccgcgaauaacuguacuuuugaguacgugucacaaccuuuccugauggaccuggaaggcaagcaggguaauuuuaaaaaccucagagaguucgucuuuaagaacauugauggguauuucaaaaucuacaguaagcauaccccaauaaauuuaguuagggaccugccccagggauuuagcgcucuugagccuuugguggaucugccaaucggcauuaacaucacacgguuccagacucuacucgcccugcaccgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuauuccguacuuuacaauucagcuaguuuuagcacauucaaaugcuacggcguuuccccaacuaagcugaacgacuuguguuuuaccaauguguaugccgauucuuucgucauuaggggugacgaagugcggcagaucgcacccgggcaaacaggaaaaaucgcugauuacaacuauaagcuaccggacgauuuuacuggcugcgucauugccuggaauagcaacaaccuggacucaaaagugggcgggaauuacaacuaucucuaccgucuguuccgcaagaguaaucuuaagccuuuugagagagauauauccaccgaaaucuaucaggcgggaagcacacccuguaacgguguugagggcuucaauugcuacuuuccacugcagucuuacggguuccaaccuaccaacggagugggcuaucagcccuacaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaucagggcgugaauuguacugaagucccuguugccauccaugcagaccagcugacaccaaccuggcgcguguacagcacaggguccaacguguuucaaacuagagccggaugccucaucggcgcugagcacguaaacaauucauaugaaugugauauucccaucggugcggggauuugcgcaaguuaccagacccagacgaacucuccuaggcgggcccgcagcgucgcuucccagucaauaaucgccuauaccaugagccugggcgcagaaaauucuguggccuacuccaacaauaguauugcuaucccaacaaacuucacuaucagcguuaccacagaaauucuucccgugucuaugacuaagaccuccgucgacuguacgauguacauaugcggagauucaacagaguguaguaaucuguugcuccaauauggcagcuuuugcacccagcugaacagagccuuaacugggaucgcaguggagcaggacaaaaauacacaggaaguuuucgcgcaagugaagcagauuuacaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauauggggauugucuuggagacaucgcagcccgugauuugauuugcgcucagaaguucaacggccugaccguccugcccccacucuuaacagacgaaaugaucgcccaguacacgucagcacugcuugcugguaccauuacgaguggguggacauuuggcgccggagcggccuugcagaucccuuucgcuaugcaaauggcauaucgguuuaauggcauaggggugacccagaacgugcucuacgagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguaugugacacagcaguugauccgcgcagcugagauucgggccucagcaaaccucgccgcuaccaaaaugucugaaugcguucugggacagaguaagagaguggauuucuguggcaaagguuaccaucuaauguccuuuccccaaagcgcgccacacggcgucguguuccugcacguuacuuacgugccggcccaggagaagaauuuuaccacagcuccugcaaucugccaugacgggaaagcccacuuccccagggaaggagucuuuguaucuaacggcacucauugguucgugacccagcgcaauuuuuaugagccacagauaauuacaacggauaacaccuucguuagcgggaauugugacguggucaucggaaucgugaacaauacuguauacgauccccuccaaccugagcuggacuccuucaaggaagaacuugauaaauauuuuaagaaccacacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcauuauacauga

SEQ ID NO: 12017 - RNA, 3822 nt, Artificial Sequence
  SARS-CoV-2/Iceland/189/2020__EPI_ISL_417709 spike protein CDS human (1-1273)
auguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucaccaaacaauacggggauugucuuggagacauagcagcccgugauuugaucugcgcucagaaguucaacggccugacaguccucccuccacuguuaacggacgaaaugauugcccaguauaccucagcacugcuugcugguacuaucacaaguggguggaccuuuggcgccggagcggccuugcagauuccuuucgcuaugcaaauggcauaccgguuuaauggcaucggggugacacagaacgugcucuaugagaaucagaaacugauagccaaccaguucaacuccgcuauuggaaagauccaagauucucuaagcuccacugccucagcacugggcaaacuccaggacgucguuaaucagaacgcgcaggcccugaauacccuugugaagcaauugagcaguaacuuuggugcuauuucuuccguacugaaugacaucuuaagccgacucgauaagguggaagccgagguccagauagacagacugaucacggggaggcuucagucgcugcaaacauacgugacccagcaguugauucgcgcagcugagauccgggccucagcaaaccucgccgcuacuaaaaugucugaaugcguucugggacagaguaagagaguggauuucuguggcaaagguuaccaccuaauguccuuuccccaaagcgcgccacauggcgucguguuccugcacguuaccuaugugccggcccaggagaagaauuuuacaacugcacccgcuauuugccacgacgggaaagcccauuuccccagggaaggagucuuuguaucuaacggcacccacugguucgugacacagcgcaauuuuuacgagccacagaucauaacgaccgauaacacuuucguuagcgggaauugugacguggucauuggaaucgugaacaauacaguauaugauccccuccaaccugagcuggacuccuucaaggaagaacuugauaaauacuuuaagaaccauaccucaccagacguggauuugggcgacaucagugguauuaaugccagcgucguuaacauccagaaggaaauugaucgacugaaugagguggcuaaaaacuuaaacgaaucucucauagaccugcaggagcuugggaaguaugagcaguacaucaaauggcccugguauauuuggcugggauucaucgcaggccuaauugccaucgugauggucacuauaaugcucugcuguaugacauccugcuguucaugccugaaggguuguugcaguuguggcagcugcugcaaauuugacgaagaugacuccgagccuguguugaaggggguuaagcugcacuacaccuga

SEQ ID NO: 12018 - RNA, 3822 nt, Artificial Sequence
  SARS-CoV-2/Australia/NSW56/2020__EPI_ISL_417408 spike protein CDS human (1-1273)
auguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggaucuuuuugcacccagcugaacagagccuuaacuggcaucgcaguggagcaggauaaaaauacacaggaaguuuucgcgcaagugaagcagauuuauaaaaccccgccuaucaaggacuuugggggauucaacuuuucgcagauucugccagauuccucuaaacccagcaagaggucauucaucgaggaccuacucuuuaauaagguaacucuggcugaugccgguuucauaaaacaauacggcgacugucuuggggauaucgcagcccgugacuugauuugcgcucagaaguucaacggacugaccguccucccuccccuguuaacagaugaaaugaucgcccaguauacgagugcacugcuugcuggcaccauuacuuccgguuggacauuuggggccggcgcggccuugcagaucccauucgcuaugcaaauggcauaccgguuuaauggaauaggcgugacccagaacgugcucuaugagaaucagaaacugauugccaaccaguucaacucugcuaucgggaagauucaagacagccuauccucaacagccagcgcacugggaaaacuccaggacgucguuaaucagaacgcgcaggcccugaauacucuugugaagcaauugaguucuaacuuuggcgcuaucuccagcguacugaaugauauauuaucgcgacucgacaagguggaagccgagguccagaucgauagacugauuaccgguaggcuucagucacugcaaacguacgugacacagcaguugauccgcgcagcugagauucgggccucugcaaaccucgccgcuaccaaaaugagugaaugcguucuggggcaguccaagagaguggacuucuguggaaaaggcuaccaccuaaugagcuuuccucaaucugcgccccauggugucguguuccugcacguuacuuaugugccagcccaggagaagaauuuuaccacagcaccggcuaucugccacgauggcaaagcccauuucccuagggaaggggucuuuguaagcaacggaacucacugguucgugacccagcgcaauuuuuacgagccccagauaauuacaacggacaacaccuucguuuccggcaauugugauguggucaucgggaucgugaacaauacuguauaugacccacuccaacccgagcuggauucauucaaggaagaacuugacaaauacuuuaagaaccauacaaguccugauguggacuugggagauauuagcggcaucaaugccucugucguuaacauucagaaggaaauagaccgacugaaugagguggcuaaaaacuuaaacgaaucccucaucgaccugcaggagcuugguaaguaugagcaguacauuaaauggccaugguauaucuggcugggguucauugcaggacuaaucgccauagugauggucaccaucaugcucugcuguaugacuucaugcuguaguugccugaagggcuguugcagcugugguuccugcugcaaauuugaugaagacgauucugagcccguguugaagggcguuaagcugcacuacacauga

SEQ ID NO: 12019 - RNA, 3822 nt, Artificial Sequence
  SARS-CoV-2/Iceland/280/2020__EPI_ISL_417608 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucacacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaguacggcagcuuuugcacccaacugaacagagccuuaacugggaucgcaguggagcaggacaaaaauacacaggaaguuuucgcacaggugaagcaaauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaguacggggauugucuuggagacaucgcagcccgugauuugauuugcgcucaaaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcagauggcauaccgguuuaauggcauaggggugacccaaaacgugcucuaugagaaucagaaacugauugccaaccaguucaacuccgcuaucggaaagauucaggauucucuaagcuccacagccucagcacugggcaaacuccaagacgucguuaaucagaacgcgcaggcccugaauacucuugugaagcaguugagcaguaacuuuggugcuaucucuuccguacugaaugacauauuaagccgacucgauaagguggaagccgagguccaaaucgacagacugauuaccgggaggcuucagucgcugcagacguacgugacacaacaguugauccgcgcagcugagauucgggccucagcaaaccucgccgcuaccaaaaugucugaaugcguucugggacagaguaagagaguggauuucuguggcaaagguuaccaucuaauguccuuuccccagagcgcgccacacggcgucguguuccugcacguuacuuaugugccggcccaagagaagaauuuuaccacagcgccugcuaucugccaugacgggaaagcccacuuccccagggaaggagucuuuguaucuaacggcacucauugguucgugacccagcgcaauuuuuacgagccacagauaauuacaacggauaacaccuucguuagcgggaauugugacguggucaucggaaucgugaacaauacuguauaugauccccuccagccugagcuggacuccuucaaggaagaacuugauaaauacuuuaagaaccacacaucaccagacguggauuugggcgacauuagugguaucaaugccagcgucguuaacauucaaaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcauuacacauga

SEQ ID NO: 12020 - RNA, 3822 nt, Artificial Sequence
  SARS-CoV-2/Iceland/247/2020__EPI_ISL_417575 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugaucgucaccauuaugcucugcuguaugacuuccugcuguucaugccugaaggguuguugcaguuguggcagcugcugcaaauuugacgaagaugacuccgagccuguguugaaggggguuaagcugcacuacacauga

SEQ ID NO: 12021 - RNA, 3822 nt, Artificial Sequence
  SARS-CoV-2/Iceland/238/2020__EPI_ISL_417566 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgucggcuucauaaaacaauacggggauugucuuggagacaucgccgcacgugauuugauuugcgcccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacauga

SEQ ID NO: 12022 - RNA, 3822 nt, Artificial Sequence
  SARS-CoV-2/Greece/16/2020__EPI_ISL_418265 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacguugauggguacuucaaaauuuacaguaagcacaccccaaucaauuuagugagggaccugccccagggauuuagcgcucuugagccuuugguagaucugccaauaggcaucaacauuacacgguuccagacucuacucgcccugcaucgcucuuaucuuaccccgggcgacuccucaagcggguggacagcaggagccgcugcauacuauguggguuaccugcaacccagaaccuuuuugcucaaauauaaugaaaacggcacgaucacugaugccgucgacugcgcucuggauccuuuaagugagacaaaguguacccugaagucuuucacuguggaaaaagggauuuaccagacauccaauuuuaggguucagccaaccgagagcaucgugcgguuccccaacauaacgaaucucugcccuuuuggagaggucuucaacgccacccgcuucgcgucgguguaugcauggaaucgaaagagaauuucuaacuguguagccgacuacuccguucuuuacaauucagcuaguuuuagcacauucaaaugcuauggcguguccccaacuaagcugaacgacuuguguuuuaccaaugucuacgccgauucuuucgugaucaggggugacgaaguccggcagauugcacccgggcaaacaggaaaaaucgcugauuauaacuacaagcuaccggacgauuuuacuggcugcgugaucgccuggaauagcaacaaccuggacucaaaaguuggcgggaauuauaacuaccucuaucgucuguuccgcaagaguaaucuuaagccuuuugagagagauauuuccaccgaaauauaccaggcgggaagcacacccuguaacgguguggagggcuucaauugcuacuuuccacugcagucuuauggguuccaaccuaccaacggaguaggcuaccagcccuauagggucgugguuuugucauuugaacuccugcacgccccagcaacugugugcggucccaaaaagaguacgaauuuagucaaaaacaagugugugaauuucaacuuuaaugggcugacaggcaccggaguacuaacugagagcaacaaaaaguuccucccuuuccagcaguuuggccgggacaucgcugauaccacagacgccgugcgagauccacaaacccuggagauucuugacaucacuccgugcuccuucgggggaguuucugucauaacacccgguacgaauaccucgaaccagguggcuguguuguaccaggacgucaauuguacugaaguuccuguggccauucacgcagaucagcugacaccaaccuggcgcguguauagcacaggcuccaacguauuucaaacuagagccgggugccucaucggagcugagcaugucaacaauucauacgaaugugacauccccauuggcgcggguaucugcgcaaguuaucagacccagacgaacucuccuaggcgggcccgcagcguggcuucccagucaauuauagccuacaccaugagccugggggcagaaaauucuguugccuacuccaacaauaguaucgcuauuccaacaaacuucacuaucagcgugaccacagaaauccuucccgucucuaugacuaagaccuccguggauuguacgauguauauuugcggcgacucaacagaguguaguaaucuguugcuccaauacggcagcuuuugcacccagcugaacagagccuuaacuggaauagcaguugagcaggauaaaaauacacaggaaguguucgcgcaaguaaagcagaucuauaaaaccccgccuauuaaggacuuugggggauucaacuuuucgcagauccugccagaucccuccaaaccuucuaagaggagcuucauugaggaccuacucuuuaauaaggucacucuggcugaugccgguuucaucaaacaauacggcgacugucuuggggauauagcagcccgugacuugaucugcgcucagaaguucaacggacugaccgugcugcccccacucuuaacagaugaaaugauugcccaguauacgucagcacugcuugcuggcaccaucacgagugguuggacauuuggggccggcgcggccuugcagauuccuuucgcuaugcaaauggcauaccgguuuaauggaaucggcgugacccagaacguccucuaugagaaucagaaacugauagccaaccaguucaacuccgcuauugggaagauccaagacucucuaagcuccacagccucagcacugggaaaacuccaggacguugugaaucagaacgcgcaggcccugaauacucuuguaaagcaauugagcaguaacuuuggcgcuauuucuuccgugcugaaugauaucuuaagccgacucgacaaggucgaagccgaggugcagauagauagacugaucaccgguaggcuucagucgcugcaaacguacguuacacagcaguugauucgcgcagcugagauccgggccucagcaaaccucgccgcuaccaaaaugucugaaugcgugcuggggcagaguaagagagucgacuucuguggaaaaggcuaccaccuaauguccuuuccccaaagcgcgccacauggugugguuuuccugcacgugacuuaugucccggcccaggagaagaauuuuaccacagcuccugcaauuugccacgauggcaaagcccauuuccccagggaagggguauuugugucuaacggaacucacugguucguuacccagcgcaauuuuuacgagccacagaucauaacaacggacaacaccuucgugagcggcaauugugaugucgugauugggaucguaaacaauacuguguaugacccccuccaaccugagcuggauuccuucaaggaggaacuugacaaauacuuuaagaaccauacaucaccagaugucgacuugggagauaucaguggcauuaaugccagcguugugaacauccagaaggaaauugaccgacugaaugagguggcuaaaaacuuaaacgaaucucucauagaccugcaggagcuugguaaguaugagcaguacaucaaauggcccugguauauuuggcugggguucaucgcaggacuaauugccaucgucauggugaccauaaugcucugcuguaugacuuccugcuguucaugccugaagggcuguugcaguugugguagcugcugcaaauuugaugaagacgauuccgagccuguuuugaagggcguaaagcugcacuacacauga

SEQ ID NO: 12023 - RNA, 3822 nt, Artificial Sequence
  SARS-CoV-2/Iceland/319/2020__EPI_ISL_417648 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauugaccuggaaggcaagcaggguaauuuuaaaaaccucagagaguucgucuuuaagaacaucgauggguacuucaaaauauacaguaagcacaccccaaucaauuuaguuagggaccugccccagggauuuagcgcucuugagccuuugguggaucugccaauuggcaucaacauuacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgaucacugaugccguggacugcgcucuggauccuuuaagugagacaaaguguacccugaagucuuucacugucgaaaaagggauauaccagacauccaauuuuagggugcagccaaccgagagcauuguucgguuccccaacaucacgaaucucugcccuuuuggagagguguucaacgccacccgcuucgcgucggucuaugcauggaaucgaaagagaauuucuaacuguguggccgacuacuccguacuuuacaauucagcuaguuuuagcacauucaaaugcuauggcguuuccccaacuaagcugaacgacuuguguuuuaccaauguguacgccgauucuuucgucaucaggggugacgaagugcggcagaucgcacccgggcaaacaggaaaaauugcugauuauaacuacaagcuaccggacgauuuuacuggcugcgucauagccuggaauagcaacaaccuggacucaaaagugggcgggaauuauaacuaccucuaucgucuguuccgcaagaguaaucuuaagccuuuugagagagauaucuccaccgaaauuuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacaucgcugauaccacagacgccguacgagauccacaaacccuggagauacuugacauuacuccgugcuccuucgggggagugucuguuaucacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucauuggcgcugagcauguaaacaauucauacgaaugugauauccccauuggugcggggauaugcgcaaguuaucagacccagacgaacucuccuaggcgggcccgcagcgucgcuucccagucaaucauugccuacaccaugagccugggcgcagaaaauucuguggccuacuccaacaauaguaucgcuaucccaacaaacuucacuauuagcguuaccacagaaauacuucccgugucuaugacuaagaccuccgucgacuguacgauguauaucugcggagauucaacagaguguaguaaucuguugcuccaauacggcagcuuuugcacccagcugaacagagccuuaacugggauugcaguggagcaggacaaaaauacacaggaaguuuucgcgcaagugaagcagaucuauaaaaccccgccuauuaaggauuuuggagguuucaacuuuucgcagauccugccagaccccuccaaaccuucuaagaggagcuucauagaggaucuacucuuuaauaagguaacucuggcugacgccggcuucaucaaacaauacggggauugucuuggagacauugcagcccgugauuugaucugcgcucagaaguucaacggccugaccguccugcccccacucuuaacagacgaaaugauugcccaguauacgucagcacugcuugcugguaccaucacgaguggguggacauuuggcgccggagcggccuugcagauaccuuucgcuaugcaaauggcauaccgguuuaauggcauuggggugacccagaacgugcucuaugagaaucagaaacugaucgccaaccaguucaacuccgcuauuggaaagauccaagauucucuaagcuccacagccucagcacugggcaaacuccaggacgucguuaaucagaacgcgcaggcccugaauacucuugugaagcaauugagcaguaacuuuggugcuauaucuuccguacugaaugacaucuuaagccgacucgauaagguggaagccgagguccagauugacagacugaucaccgggaggcuucagucgcugcaaacguacgugacacagcaguugauucgcgcagcugagauccgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaauaugccacgacgggaaagcccauuuccccagggaaggagucuuuguaucuaacggcacucacugguucgugacccagcgcaauuuuuacgagccacagauuaucacaacggauaacaccuucguuagcgggaauugugacguggucaucggaauugugaacaauacuguauaugauccccuccaaccugagcuggacuccuucaaggaagaacuugauaaauacuuuaagaaccauacaucaccagacguggauuugggcgacaucagugguauuaaugccagcgucguuaacauacagaaggaaaucgaucgacugaaugagguggcuaaaaacuuaaacgaaucucucauugaccugcaggagcuugggaaguaugagcaguacaucaaauggcccugguauauuuggcugggauucaucgcaggccuaauagccaucgugauggucaccauuaugcucugcuguaugacuuccugcuguucaugccugaaggguuguugcaguuguggcagcugcugcaaauuugacgaagaugacuccgagccuguguugaaggggguuaagcugcacuacacauga

SEQ ID NO: 12024 - RNA, 3822 nt, Artificial Sequence
  SARS-CoV-2/Congo/94/2020__EPI_ISL_417947 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggauauacuauuuaauaagguaacucucgcugacgccggcuucaucaaacaauacggggauugucugggagacauugcagcccgugaucuuaucugcgcucagaaguucaacggcuugaccguccugcccccacuccugacagacgaaaugauugcccaguauacgucagcauuacuggcugguaccaucacgaguggguggacauuuggcgccggagcggcccuucagauaccuuucgcuaugcaaauggcauaccgguuuaauggcauuggggugacccagaacguguuguaugagaaucagaaacucaucgccaaccaguucaacuccgcuauuggaaagauccaagauucucugagcuccacagccucagcacuaggcaaacugcaggacgucguuaaucagaacgcgcaggcccucaauacucuggugaagcaacuuagcaguaacuuuggugcuauaucuuccguauugaaugacauccugagccgauuagauaagguggaagccgagguccagauugacagacucaucaccgggaggcugcagucgcuucaaacguacgugacacagcagcugauucgcgcagcugagauccgggccucagcaaacuuggccgcuaccaaaaugucugaaugcguucucggacagaguaagagaguggauuucuguggcaaagguuaccaccugauguccuuuccccaaagcgcgccacauggcgucguguuccuacacguuacuuaugugccggcccaggagaagaauuuuaccacagcuccugcaauaugccacgacgggaaagcccauuuccccagggaaggagucuuuguaucuaacggcacucacugguucgugacccagcgcaauuuuuacgagccacagauuaucacaacggauaacaccuucguuagcgggaauugugacguggucaucggaauugugaacaauacuguauaugauccccugcaaccugagcucgacuccuucaaggaagaacuggauaaauacuuuaagaaccauacaucaccagacguggaucuuggcgacaucagugguauuaaugccagcgucguuaacauacagaaggaaaucgaucgauugaaugagguggcuaaaaaccugaacgaaucuuuaauugaccuccaggagcuggggaaguaugagcaguacaucaaauggcccugguauauuuggcuuggauucaucgcaggccugauagccaucgugauggucaccauuaugcuaugcuguaugacuuccugcuguucaugccucaaggguuguugcaguuguggcagcugcugcaaauuugacgaagaugacuccgagccugugcugaaggggguuaaguugcacuacacauga

SEQ ID NO: 12025 - RNA, 3822 nt, Artificial Sequence
  SARS-CoV-2/Congo/158/2020__EPI_ISL_417950 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuuccucagcggcaauugugauguugugaucgggaucgucaacaauacuguguaugacccccugcaaccugagcuugauuccuucaaggaagaguuggacaaauacuuuaagaaccauacaucaccagauguagaccugggagauauuaguggcaucaaugccagcguggucaacauucagaaggaaauagaccgauuaaaugagguugcuaaaaaccucaacgaaucucugaucgaccuucaggagcuggguaaguaugagcaguacauuaaauggcccugguauaucuggcuaggguucauugcaggacucaucgccauagugauggugaccaucaugcugugcuguaugacuuccugcuguucaugcuugaagggcuguugcaguugugguagcugcugcaaauuugaugaagacgauuccgagccuguccugaagggcgugaaguuacacuacacauga

SEQ ID NO: 12026 - RNA, 3822 nt, Artificial Sequence
  SARS-CoV-2/USA/UT-00034/2020__EPI_ISL_417977 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuauuacaaaaauaacaaguccuggauggagucugaguuccguguguauagcuccgcgaauaacuguacuuuugaguacgugucacaaccuuuccugauggaccuggaaggcaagcaggguaauuuuaaaaaccucagagaguucgucuuuaagaacauugauggguacuucaaaaucuauaguaagcauaccccaauaaauuuaguuagggaccugccccagggauuuagcgcucuugagccuuugguggaucugccaaucggcauuaacaucacacgguuccagacucuacucgcccugcaccgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuacuccguacuuuauaauucagcuaguuuuagcacauucaaaugcuacggcguuuccccaacuaagcugaacgacuuguguuuuaccaauguguaugccgauucuuucgucauuaggggugacgaagugcggcagaucgcacccgggcaaacaggaaaaaucgcugauuacaacuauaagcuaccggacgauuuuacuggcugcgucauugccuggaauagcaacaaccuggacucaaaagugggcgggaauuacaacuaucucuaccgucuguuccgcaagaguaaucuuaagccuuuugagagagauauauccaccgaaaucuaccaggcgggaagcacacccuguaacgguguugagggcuucaauugcuauuuuccacugcagucuuacggguuccaaccuaccaacggagugggcuaucagcccuacaggguagucguguugucauuugaacuccugcaugccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaucagggcgugaauuguacugaagucccuguugccauccacgcagaccagcugacaccaaccuggcgcguguacagcacaggguccaacguguuucaaacuagagccggaugccucaucggcgcugagcacguaaacaauucauaugaaugugauauucccaucggugcggggauuugcgcaaguuaccagacccagacgaacucuccuaggcgggcccgcagcgucgcuucccagucaauaaucgccuacaccaugagccugggcgcagaaaauucuguggccuauuccaacaauaguauugcuaucccaacaaacuucacuaucagcguuaccacagaaauucuucccgugucuaugacuaagaccuccgucgacuguacgauguacauaugcggagauucaacagaguguaguaaucuguugcuccaauauggcagcuuuugcacccagcugaacagagccuuaacugggaucgcaguggagcaggacaaaaauacacaggaaguuuucgcgcaagugaagcagauuuacaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauauggggauugucuuggagacaucgcagcccgugauuugauuugcgcucagaaguucaacggccugaccguccugcccccacucuuaacagacgaaaugaucgcccaguacacgucagcacugcuugcugguaccauuacgaguggguggacauuuggcgccggagcggccuugcagaucccuuucgcuaugcaaauggcauaucgguuuaauggcauaggggugacccagaacgugcucuacgagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaucaucuaauguccuuuccccaaagcgcgccacacggcgucguguuccugcauguuacuuacgugccggcccaggagaagaauuuuaccacagcuccugcaaucugccacgacgggaaagcccacuuccccagggaaggagucuuuguaucuaacggcacucauugguucgugacccagcgcaauuuuuaugagccacagauaauuacaacggauaacaccuucguuagcgggaauugugacguggucaucggaaucgugaacaauacuguauacgauccccuccaaccugagcuggacuccuucaaggaagaacuugauaaauauuuuaagaaccacacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcauuacacauga

SEQ ID NO: 12027 - RNA, 3822 nt, Artificial Sequence
  SARS-CoV-2/USA/UT-00033/2020__EPI_ISL_417976 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcgggcugacagcaggagccgcugcauacuauguagguuacuugcaacccagaaccuuucuccugaaauauaaugaaaacggcacgauuacugaugccguggacugcgcuuuagauccucugagugagacaaaguguacccucaagucuuucacugucgaaaaagggaucuaccagacauccaauuuuagggugcagccaaccgagagcauaguucgguuccccaacauuacgaaucuuugcccuuuuggagagguguucaacgccacccgcuucgcgucggucuaugcauggaaucgaaagagaaucucuaacuguguggccgacuacuccguacuguacaauucagcuaguuuuagcacauucaaaugcuauggcguuuccccaacuaaguugaacgaccuauguuuuaccaauguguacgccgauucuuucgucauuaggggugacgaagugcggcagaucgcacccgggcaaacaggaaaaaucgcugauuauaacuacaagcugccggacgauuuuacuggcugcgucauugccuggaauagcaacaaccucgacucaaaagugggcgggaauuauaacuaccuguaucgucuuuuccgcaagaguaaucugaagccuuuugagagagauauauccaccgaaaucuaccaggcgggaagcacacccuguaacgguguugagggcuucaauugcuacuuuccauugcagucuuauggguuccaaccuaccaacggagugggcuaccagcccuauaggguagucgugcucucauuugaacuguuacacgccccagcaacuguuugcggucccaaaaagaguacgaaucuggugaaaaacaagugugucaauuucaacuuuaaugggcuaacaggcaccggagugcucacugagagcaacaaaaaguuccugccuuuccagcaguuuggccgggacauugcugauaccacagacgccguacgagauccacaaacccuugagaucuuggacauaacuccgugcuccuucgggggagugucuguuauuacacccgguacgaauaccucgaaccaggucgcugugcuguaccagggcgugaauuguacugaagucccuguugccauccacgcagaccagcucacaccaaccuggcgcguguauagcacaggguccaacguguuucaaacuagagccggaugccugaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccuuggcgcagaaaauucuguggccuacuccaacaauaguauugcuaucccaacaaacuucacuaucagcguuaccacagaaauucugcccgugucuaugacuaagaccuccgucgacuguacgauguauauaugcggagauucaacagaguguaguaauuugcuccugcaauacggcagcuuuugcacccaguuaaacagagcccugacugggaucgcaguggagcaggacaaaaauacacaggaaguuuucgcgcaagugaagcagauuuauaaaaccccgccuaucaaggauuuuggagguuucaacuuuucgcagauucuaccagaccccuccaaaccuucuaagaggagcuucaucgaggaucuccuguuuaauaagguaacucuugcugacgccggcuucauaaaacaauacggggauuguuugggagacaucgcagcccgugaucugauuugcgcucagaaguucaacggccucaccguccugcccccauuacugacagacgaaaugaucgcccaguauacgucagcacuuuuggcugguaccauuacgaguggguggacauuuggcgccggagcggcccuccagaucccuuucgcuaugcaaauggcauaccgguuuaauggcauaggggugacccagaacgugcuguaugagaaucagaaacuaauugccaaccaguucaacuccgcuaucggaaagauucaagauucucugagcuccacagccucagcacucggcaaacugcaggacgucguuaaucagaacgcgcaggcccuuaauacuuuggugaagcaacugagcaguaacuuuggugcuaucucuuccguauuaaaugacauacucagccgacuggauaagguggaagccgagguccagaucgacagacuuauuaccgggaggcugcagucguugcaaacguacgugacacagcagcucauccgcgcagcugagauucgggccucagcaaaccuggccgcuaccaaaaugucugaaugcguucuaggacagaguaagagaguggauuucuguggcaaagguuaccaccugauguccuuuccccaaagcgcgccacauggcgucguguuccuccacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccugcaaccugagcuugacuccuucaaggaagaguuggauaaauacuuuaagaaccauacaucaccagacguggaucugggcgacauuagugguaucaaugccagcgucguuaacauucagaaggaaauagaucgauuaaaugagguggcuaaaaaccucaacgaaucucugaucgaccuucaggagcuggggaaguaugagcaguacauuaaauggcccugguauaucuggcuaggauucauugcaggccucaucgccauagugauggucaccaucaugcugugcuguaugacuuccugcuguucaugcuugaaggguuguugcaguuguggcagcugcugcaaauuugacgaagaugacuccgagccugugcugaaggggguuaaguuacacuacacauga

SEQ ID NO: 12028 - RNA, 3822 nt, Artificial Sequence
  SARS-CoV-2/USA/WI-13/2020__EPI_ISL_417516 spike protein CDS human (1-1273)
auguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcucccaaccgagagcauaguucgguuccccaacauuacgaaucuuugcccuuuuggagagguguucaacgccacccgcuucgcgucggucuaugcauggaaucgaaagagaaucucuaacuguguggccgacuacuccguacuguacaauucagcuaguuuuagcacauucaaaugcuauggcguuuccccaacuaaguugaacgaccuauguuuuaccaauguguacgccgauucuuucgucauuaggggugacgaagugcggcagaucgcacccgggcagacaggaaaaaucgcugauuauaacuacaagcugccggacgauuuuacuggcugcgucauugccuggaauagcaacaaccucgacucaaaagugggcgggaauuauaacuaccuguaucgucuuuuccgcaagaguaaucugaagccuuuugagagagauauauccaccgaaaucuaccaagcgggaagcacacccuguaacgguguugagggcuucaauugcuacuuuccauugcagucuuauggguuccagccuaccaacggagugggcuaccaacccuauaggguagucgugcucucauuugaacuguuacacgccccagcaacuguuugcggucccaaaaagaguacgaaucuggugaaaaacaagugugucaauuucaacuuuaaugggcuaacaggcaccggagugcucacugagagcaacaaaaaguuccugccuuuccagcaguuuggccgggacauugcugauaccacagacgccguacgagauccacagacccuugagaucuuggacauaacuccgugcuccuucgggggagugucuguuauuacacccgguacgaauaccucgaaccaagucgcugugcuguaccagggcgugaauuguacugaagucccuguugccauccacgcagaccagcucacaccaaccuggcgcguguauagcacaggguccaacguguuucagacuagagccggaugccugaucggcgcugagcauguaaacaauucauacgaaugugauauucccaucggugcggggauuugcgcaaguuaucaaacccagacgaacucuccuaggcgggcccgcagcgucgcuucccagucaauaaucgccuacaccaugagccuuggcgcagaaaauucuguggccuacuccaacaauaguauugcuaucccaacaaacuucacuaucagcguuaccacagaaauucugcccgugucuaugacuaagaccuccgucgacuguacgauguauauaugcggagauucaacagaguguaguaauuugcuccugcaguacggcagcuuuugcacccaauuaaacagagcccugacugggaucgcaguggagcaggacaaaaauacacaggaaguuuucgcacaggugaagcaaauuuauaaaaccccgccuaucaaggauuuuggagguuucaacuuuucgcagauucuaccagaccccuccaaaccuucuaagaggagcuucaucgaggaucuccuguuuaauaagguaacucuugcugacgccggcuucauaaaacaguacggggauuguuugggagacaucgcagcccgugaucugauuugcgcucaaaaguucaacggccucaccguccugcccccauuacugacagacgaaaugaucgcccaguauacgucagcacuuuuggcugguaccauuacgaguggguggacauuuggcgccggagcggcccuccagaucccuuucgcuaugcagauggcauaccgguuuaauggcauaggggugacccaaaacgugcuguaugagaaucagaaacuaauugccaaccaguucaacuccgcuaucggaaagauucaggauucucugagcuccacagccucagcacucggcaaacugcaagacgucguuaaucagaacgcgcaggcccuuaauacuuuggugaagcagcugagcaguaacuuuggugcuaucucuuccguauuaaaugacauacucagccgacuggauaagguggaagccgagguccaaaucgacagacuuauuaccgggaggcugcagucguugcagacguacgugacacaacagcucauccgcgcagcugagauucgggccucagcaaaccuggccgcuaccaaaaugucugaaugcguucuaggacagaguaagagaguggauuucuguggcaaagguuaccaccugauguccuuuccccagagcgcgccacauggcgucguguuccuccacguuacuuaugugccggcccaagagaagaauuuuaccacagcgccugcuaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccugcagccugagcuugacuccuucaaggaagaguuggauaaauacuuuaagaaccauacaucaccagacguggaucugggcgacauuagugguaucaaugccagcgucguuaacauucaaaaggaaauagaucgauuaaaugagguggcuaaaaaccucaacgaaucucugaucgaccuucaggagcuggggaaguaugagcaguacauuaaauggcccugguauaucuggcuaggauucauugcaggccucaucgccauagugauggucaccaucaugcugugcuguaugacuuccugcuguucaugcuugaaggguuguugcaguuguggcagcugcugcaaauuugacgaagaugacuccgagccugugcugaaggggguuaaguuacacuacacauga

SEQ ID NO: 12029 - RNA, 3819 nt, Artificial Sequence
  SARS-CoV-2/India/1-27/2020__EPI_ISL_413522 spike protein CDS human (1-1272)
auguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuaccauaaaaauaacaaguccuggauggagucugaguuccguguguauagcuccgcgaauaacuguacuuuugaauacgugucacaaccuuuccugauggaccuggaaggcaagcaggguaauuuuaaaaaccucagagaguucgucuuuaagaacauugauggguauuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuauuccguacuuuacaauucagcuaguuuuagcacauucaaaugcuacggcguuuccccaacuaagcugaacgacuuguguuuuaccaauguguaugccgauucuuucgucauuaggggugacgaagugauccagaucgcacccgggcaaacaggaaaaauugcugauuacaacuauaagcuaccggacgauuuuacuggcugcgucauagccuggaauagcaacaaccuggacucaaaagugggcgggaauuacaacuaucucuaccggcuguuccguaagaguaaucuuaagccuuuugagcgcgauaucuccaccgaaauuuaucaggcgggaagcacacccuguaacgguguugagggcuucaauugcuacuuuccacugcagucuuacggguuccaaccuaccaacggagugggcuaucagcccuacagaguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggcagggacaucgcugauaccacagacgccguacgggauccacaaacccuggagauacuugacauuacuccgugcuccuucgggggagugucuguuaucacacccgguacgaauaccucgaaccaggucgcuguguuguaucaggacgugaauuguacugaagucccuguugccauccacgcagaucagcugacaccaaccuggcgaguguacagcacaggcuccaacguguuucaaacucgcgccgggugccucauuggagcugagcauguaaacaauucauaugaaugugacauccccauuggcgcggguauaugcgcaaguuaccagacccagacgaacucuccuagaagggcccggagcgucgcuucccagucaaucauugccuauaccaugagccugggggcagaaaauucuguggccuacuccaacaauaguaucgcuaucccaacaaacuucacuauuagcguuaccacagaaauacuucccgugucuaugacuaagaccuccgucgauuguacgauguacaucugcggcgacucaacagaguguaguaaucuguugcuccaauauggaucuuuuugcacccagcugaaccgcgccuuaacuggcauugcaguggagcaggauaaaaauacacaggaaguuuucgcgcaagugaagcagaucuacaaaaccccgccuauuaaggacuuugggggauucaacuuuucgcagauccugccagaucccuccaaaccuucuaagagaaguuucauagaggaccuacucuuuaauaagguaacucuggcugaugccgguuucaucaaacaauauggcgacugucuuggggauauugcagccagggacuugaucugcgcucagaaguucaacggacugaccguccugcccccacucuuaacagaugaaaugauugcccaguacacgucagcacugcuugcuggcaccaucacuagcgguuggacauuuggggccggcgcggccuugcagauaccuuucgcuaugcaaauggcauaucguuuuaauggaauuggcgugacccagaacgugcucuacgagaaucagaaacugaucgccaaccaguucaacuccgcuauugggaagauccaagacucucuaagcuccacagccucagcacugggaaaacuccaggacgucguuaaucagaacgcgcaggcccugaauacucuugugaagcaauugagcaguaacuuuggcgcuauaucuuccguacugaaugauaucuuaagccggcucgacaagguggaagccgagguccagauugaucgacugaucaccgguagacuucagucgcugcaaacguaugugacacagcaguugauuagggcagcugagauccgcgccucagcaaaccucgccgcuaccaaaaugucugaaugcguucuggggcagaguaagcggguggacuucuguggaaaaggcuaccaccuaauguccuuuccccaaagcgcgccacauggugucguguuccugcacguuacuuacgugccggcccaggagaagaauuuuaccacagcuccugcaauaugccacgauggcaaagcccauuuccccagagaaggggucuuuguaucuaacggaacucacugguucgugacccagaggaauuuuuaugagccacagauuaucacaacggacaacaccuucguuagcggcaauugugauguggucaucgggauugugaacaauacuguauacgacccccuccaaccugagcuggauuccuucaaggaggaacuugacaaauauuuuaagaaccauacaucaccagauguggacuugggagauaucaguggcauuaaugccagcgucguuaacauacagaaggaaaucgaccgccugaaugagguggcuaaaaacuuaaacgaaucucucauugaccugcaggagcuugguaaguacgagcaguauaucaaauggcccugguacauuuggcugggguucaucgcaggacuaauagccaucgugauggucaccauuaugcucugcuguaugacuuccugcuguucaugccugaagggcuguugcaguugugguagcugcugcaaauuugaugaagacgauuccgagccuguguugaagggcguuaagcugcacuauacauga

SEQ ID NO: 12030 - RNA, 3804 nt, Artificial Sequence
  SARS-CoV-2/pangolin/Guangxi/P4L/2017__EPI_ISL_410538 spike protein CDS human (1-1267)
auguucguguuucuguucguccucccccuuguuagcucccagugcgugaaccugaccacaagaacuggcaucccuccaggguacacgaauagcucaaccaggggaguauauuacccggacaagguguuucggaguagcauuuugcacuuaacacaagaucuguuccuacccuuuuucuccaacgucacuugguuuaauaccauaaacuaucaggguggcuucaaaaaguuugacaauccugugcucccauucaacgaugggguuuacuuugccucuacagagaaaucgaauaucauucgcggauggaucuucggcaccacucuggacgcucgaacacagucacuucugauugugaacaaugcaaccaacgucgugaucaagguaugugaauuucaguucugcacggaucccuucuuggguguuuauuaccauaauaacaauaaaacuuggguggagaacgaauuucgugucuauagcagugccaauaacuguaccuucgaguacauaucccaaccuuuucucauggaccuggaagggaagcagggaaacuucaagaaucugagagaguuuguguucaaaaacguggauggcuacuuuaagaucuauucuaaacacacaccaauugaccucgucagggauuuaccccggggcuucgcggcucuggagccucuuguugacuugccaaucgggauuaauaucacucgcuuucagacccugcuagcccuccauagaagcuaccugacaccgggaaaccuugaauccgguuggaccacgggcgcagccgcuuauuacgugggguaucugcagcaaaggacuuucuugcucucauacaaucagaacggaacaauaaccgaugcaguagacugcagucuggaucccuuaagcgagacuaaguguacacugaaaucucucaccguggaaaagggcauuuaucagacguccaauuuucggguccagccuaccaucucaauugugcgcuucccaaacaucacaaaucuuugccccuuuggugagguuuucaacgccagcaaguucgcuaguguguacgccuggaaucgaaaaagaaucucuaacugugucgcggacuacuccgugcuguauaauagcacuucguuuucuaccuucaagugcuacgggguauccccuacaaaauugaacgaccuauguuuuacuaauguuuaugcagauucauucguggucaagggagacgaggugaggcaaauugccccaggccagaccggcgucauagcugauuacaacuauaaacugcccgacgauuuuacagggugcgugaucgccuggaacaguguuaagcaggacgcacucaccggagguaauuacggcuaucuguaccggcuuuuccguaaaagcaagcugaagccguuugaacgcgauauuuccacugagaucuaccaagcugggucuacgccuuguaacggacaggugggcuugaauugcuauuacccccucgaaagauaugguuuccacccaacaaccgggguaaacuaccagccuuuuagggucgugguucugagcuucgaguuacugaauggccccgccacugugugcggaccaaaacuaucaaccacacucgucaaggacaaaugugugaacuuuaauuucaacggccugaccgggacuggaguacuuacaacgaguaagaaacaguuuuugcccuuccaacaguucggucgggauauauccgacaccacugaugcggugcgagacccucagacacuggaaauucucgacaucaccccaugcagcuuuggcgggguuucugucaucacaccgggaacuaauaccucaaaccagguggccgugcuguaucaagaugucaauuguacggagguucccauggcaauucaugcugagcagcuuaccccugccuggcgcguguacagugcuggcgccaacguguuccagacaagagcagguugccugguaggggccgaacacgucaauaacagcuaugagugugacaucccagugggcgcuggaauuugcgcguccuaccacucuaugucgagcuugagguccguuaaucagcggucaauaaucgcauacacuaugagucucggcgccgaaaacucuguggcuuauagcaacaauuccauugccauccccaccaacuuuacaaucucagucacuaccgagauucugccugugagcaugacgaagacaucuguugauuguaccauguacauaugcggggacuccaucgaauguaguaauuuacugcuacaauauggaucuuucugcacucagcucaaccgcgcacugacagguauugccguggagcaggauaagaauacccaggagguauuugcucaagucaaacagaucuacaagacuccacccauuaaagacuucggcggguuuaacuucucucagauccuuccggauccuuccaagccaucaaaaagaaguuuuauagaagacuugcuguucaauaaggugacccucgccgaugcaggauuuaucaagcaauauggcgacugucugggugauauugcggcuagggacuuaaucugcgcccagaaauucaacgggcugacagugcuucccccuuugcucacggaugagaugauugcacaguacaccagcgcccugcuagcuggcacuaucacaucgggauggaccuucggcgccggggcagcucugcagauacccuuugccaugcaaauggcguaucguuucaauggaauuggcgucacacagaacguucucuacgaaaaucagaagcugaucgccaaccaguuuaauuccgcuauugguaaaauccaagacucucuuagcucaacugcaagugccuuggggaagcugcaggacgugguaaaccagaaugcucaggccuuaaacacccucgugaaacaacuguccucuaacuucggagcaauaagcuccguccuuaaugauauccugucacgguuggacaagguggaggcggaaguucagauugaucgacucaucacgggcagacugcagagccuacaaacauacgugacccagcagcugauuagggccgcugagauccgcgccagugcaaaccucgcugccacuaagaugucugagugcguccugggucaguccaaacggguggacuuuuguggcaagggguaucaucuuaugagcuucccacaaucggcaccucacggaguuguguuuuugcaugucaccuacguacccgcccaggagaaaaauuucacaacugcuccagcgauaugccacgagggcaaggcccacuuuccgagagaagggguguucguuucaaacggaacccauugguuuauuacacagaggaauuucuaugagccucagaucaucacgaccgauaacacuuuugugucuggcaguugugacgucgugauugguaucguaaauaacacaguguacgauccccugcaaccagaguuagacuccuucaaagaagaacucgauaaguauuucaaaaaucacaccagccccgacgucgaucugggggacauuucuggaauaaacgcaagcguugugaauauccagaaggaaauugaucgccuuaacgagguggcuaagaaucugaacgaauccccuaucgaccuacaggagcucggcaaauacgagcaguauauuaaguggccaugguacaucuggcuggguuuuauagccggcuugaucgccauuaucauggucacuauuaugcugugcuguaugacaucaugcuguaguugcuuaaaaggguguugcagcuguggaucuugcugcaaguucgacgaagaugacuccgagcccgugcucaaaggcguuaagcugcauuacaccuga

SEQ ID NO: 12031 - RNA, 3804 nt, Artificial Sequence
  SARS-CoV-2/pangolin/Guangxi/P5L/2017__EPI_ISL_410540 spike protein CDS human (1-1267)
auguucguguuucuguucguccucccccuuguuagcucccagugcgugaaccugaccacaagaacuggcaucccuccaggguacacgaauagcucaaccaggggaguauauuacccggacaagguguuucggaguagcauuuugcacuuaacacaagaucuguuccuacccuuuuucuccaacgucacuugguuuaauaccauaaacuaucaggguggcuucaaaaaguuugacaauccugugcucccauucaacgaugggguuuacuuugccucuacagagaaaucgaauaucauucgcggauggaucuucggcaccacucuggacgcucgaacacagucacuucugauugugaacaaugcaaccaacgucgugaucaagguaugugaauuucaguucugcacggaucccuucuuggguguuuauuaccauaauaacaauaaaacuuggguggagaacgaauuucgugucuauagcagugccaauaacuguaccuucgaguacauaucccaaccuuuucucauggaccuggaagggaagcagggaaacuucaagaaucugagagaguuuguguucaaaaacguggauggcuacuuuaagaucuauucuaaacacacaccaauugaccucgucagggauuuaccccggggcuucgcggcucuggagccucuuguugacuugccaaucgggauuaauaucacucgcuuucagacccugcuagcccuccauagaagcuaccugacaccgggaaaacuugaauccgguuggaccacgggcgcagccgcuuauuacgugggguaucugcagcaaaggacuuucuugcucucauacaaccagaauggaacaauaaccgaugcaguagacugcagucuggaucccuuaagcgagacuaaguguacacugaagucucucaccguggaaaagggcauuuaucagacguccaacuuucggguccagccuaccaucucaauugugcgcuucccaaauaucacaaaccuuugccccuuuggugagguuuucaaugccagcaaauucgcuaguguguacgccuggaaccgaaagagaaucucuaauugugucgcggacuacuccgugcuguauaacagcacuucguuuucuaccuucaaaugcuacgggguauccccuacaaaguugaaugaccuauguuuuacuaacguuuaugcagauucauucguggucaaaggagacgaggugaggcaaauugccccaggccagaccggcgucauagcugauuacaauuauaagcugcccgacgauuuuacagggugcgugaucgccuggaacaguguuaaacaggacgcacucaccggagguaacuacggcuaucuguaccggcuuuuccguaagagcaagcugaaaccguuugaacgcgauauuuccacugagaucuaccaagcugggucuacgccuuguaauggacaggugggcuugaacugcuauuacccccucgaaagauaugguuuccacccaacaaccgggguaaauuaccagccuuuuagggucgugguucugagcuucgaguuacugaacggccccgccacugugugcggaccaaagcuaucaaccacacucgucaaagacaagugugugaauuuuaacuucaauggccugaccgggacuggaguacuuacaacgaguaaaaagcaguuuuugcccuuccaacaguucggucgggauauauccgacaccacugaugcggugcgagacccucagacacuggaaauucucgacaucaccccaugcagcuuuggcgggguuucugucaucacaccgggaacuaacaccucaaaucagguggccgugcuguaucaagaugucaacuguacggagguucccauggcaauucaugcugagcagcuuaccccugccuggcgcguguacagugcuggcgccaauguguuccagacaagagcagguugccugguaggggccgaacacgucaacaauagcuaugagugugacaucccagugggcgcuggaauuugcgcguccuaccacucuaugucgagcuuuagguccguuaaccagcggucaauaaucgcauacacuaugaguuugggcgccgaaaauucuguggcuuauagcaacaacuccauugccauccccaccaauuucacaaucucagucacuaccgagauucucccugugagcaugacgaagacaucuguugauuguaccauguacauaugcggggacuccaucgaauguaguaaccuguuacugcaauauggaucuuuuugcacucagcuaaaucgcgcacucacagguauugccguggagcaggauaaaaacacccaggagguauucgcucaagucaagcagaucuacaaaacuccacccauuaaggacuuuggcggguucaauuuuucucagauccugccggauccuuccaaaccaucaaagagaaguuucauagaagaccuuuuguuuaacaaggugacccuggccgaugcaggauucaucaaacaauauggcgacugucucggugauauugcggcuagggaccugaucugcgcccagaaguucaauggguuaacagugcugcccccucuuuugacggaugagaugauugcacaguacaccagcgcccuccuggcuggcacuaucacaucgggauggaccuuuggcgccggggcagcucuacagauacccuucgccaugcaaauggcguaucguuuuaacggaauuggcgucacacagaauguucuguacgaaaaccagaaacucaucgccaaucaguucaacuccgcuauugguaagauccaagacucucugagcucaacugcaagugcccuugggaaauugcaggacgugguaaaucagaacgcucaggcccugaauaccuuagugaagcaacucuccucuaacuuuggagcaauaagcuccguccugaacgauauccuuucacggcuggacaagguggaggcggaaguucagauugaucgauugaucacgggcagacuccagagccugcaaacauacgugacccagcagcuaauuagggccgcugagauccgcgccagugcaaaucuggcugccacuaaaaugucugagugcguccucggucaguccaagcggguggacuucuguggcaaaggguaucaucugaugagcuuuccacaaucggcaccucacggaguuguguuccuucaugucaccuacguacccgcccaggaaaagaacuuuacaacugcuccagcgauaugccacgagggcaaagcccacuucccgagagaagggguguuuguuucaaauggaacccauugguucauuacacagaggaacuuuuaugagccucagaucaucacgaccgauaauacuuucgugucuggcaguugugacgucgugauugguaucguaaacaauacaguguacgaucccuugcaaccagagcuggacuccuucaaggaagaguuagauaaauauuuuaagaaccacaccagccccgacgucgaucucggggacauuucuggaauaaaugcaagcguugugaacauccagaaggaaauugaucgccugaaugagguggcuaaaaaccuuaaugaaucccugaucgaccuacaggagcucggcaaguacgagcaguauauuaaauggccuugguacaucuggcuggguuucauagccggcuugaucgccauuaucauggucacuauuaugcugugcuguaugacaucaugcuguaguugcuuaaagggguguugcagcuguggaucuugcugcaaauuugacgaagaugacuccgagccagugcucaagggcguuaagcugcauuacaccuga

SEQ ID NO: 12032 - RNA, 3804 nt, Artificial Sequence
  SARS-CoV-2/pangolin/Guangxi/P5E/2017__EPI_ISL_410541 spike protein CDS human (1-1267)
auguucguguuucuguucguccucccccuuguuagcucccagugcgugaaccugaccacaagaacuggcaucccuccaggguacacaaauucuucaaccaggggaguauauuacccggacaagguguuucggaguagcauuuugcacuuaacacaagaucuguuccuacccuuuuucuccaacgucacuugguuuaauaccauaacauaucaggguggcucuaaaaaguucgacaacccugugcucccauuuaaugaugggguuuacuucgccucgaccgagaaaucaaacaucauucgcggauggaucuuuggcacuacacuggacgcucgaacccagagccuucugauugugaauaacgcaacgaaugucgugaucaagguaugugaguuccaguuuugcacugaucccuucuuggguguuuauuaccauaacaauaacaaaaccuggguggaaaaugaguuccgugucuauaguuccgccaacaauuguacauuugaauacauaucucaaccuuuccucauggaccuggaagggaagcagggaaacuuuaagaaccugagagaguucguguuuaaaaauguggauggcuacuucaagaucuauagcaaacacacuccaauugaccucgucagggauuuaccccggggcuuugcggcucuggagccucuuguugacuugccaaucgggauuaacaucacccgcuuccagacacugcuagcccuccauagauccuaccugaccccgggaaaacuugaaucagguuggacgacuggcgcagccgcuuauuacgugggguaucugcagcaaaggacauuuuugcucaguuacaaucagaacggaaccauaacugaugcaguagacugcagccuggaucccuuaucugagacaaaguguacccugaagucccucacgguggaaaagggcauuuaucagaccucaaauuuccggguccagccuacaaucagcauugugcgcuuuccaaacaucacuaaucuuugccccuucggugagguuuuuaacgccaguaaauucgcuucuguguacgccuggaaucgaaagagaaucuccaacugugucgcggacuacagcgugcuguauaauucgaccucuuucuccacauuuaaaugcuacgggguaucaccuacuaaguugaacgaccuauguuucaccaauguuuaugcagauaguuuuguggucaaaggagacgaggugaggcaaauugccccaggccagacaggcgucauagcugauuacaacuauaagcugcccgacgauuucaccgggugcgugaucgccuggaauagcguuaaacaggacgcacucacuggagauaacuacgguuaucuguaccggcuuuuucguaaguccaagcugaaaccguucgaacgcgacauuucuacggagaucuaccaagcuggcagcacaccuuguaacggacaggugggguugaauugcuauuacccccucgaaagauauggcuuucacccaaccacugguguaaacuaccagccuuucagggucgugguucugucauuugaguuacugaaugggcccgccaccgugugcggcccaaagcuaaguacaacccucgucaaagauaagugugugaacuucaauuuuaacggacugacuggcacagggguacuuacgaccuccaaaaagcaguucuugcccuuucaacaguucggacgggacauaagcgauacuacagacgcggugcgagacccucagacccuggaaauucucgauaucacaccaugcucuuucgguggcguuucagucaucacuccggggaccaauacgaguaaccagguggccgugcuguaucaagacgucaauuguaccgagguucccauggcaauucaugcugagcagcuuacgccugccuggcgcguguacagcgcuggagccaacguguuucagacuagagcaggcugccugguaggugccgaacacgucaauaacuccuaugagugugauaucccagugggggcuggcauuugcgcgucuuaccacucgaugagcuccuucaggucaguuaaucagcggaguauaaucgcauacaccaugucuuugggagccgaaaacagcguggcuuauuccaauaacucaauugccauccccacaaacuuuacuaucagcgucaccacggagauucucccugugucuaugacaaagaccuccguugacuguacuauguacauaugcggcgauaguaucgaauguagcaaucuguuacugcaauaugggucuuucugcacacagcuaaaccgcgcacucaccggaauugccguggagcaggacaaaaauacucaggagguauuugcucaagucaagcagaucuacaaaaccccacccauuaaggauuucgguggcuuuaacuucucccagauccugccggacccuucaaaaccaaguaagaggagcuuuauagaagaucuuuuguucaauaaggugacacuggccgacgcaggguuuaucaaacaauauggagauugucucggcgacauugcggcuagagaucugaucugcgcccagaaguucaacgguuuaacggugcugcccccucuuuugaccgacgagaugauugcacaguacacuucggcccuccuggcugggacaaucaccuccggcuggacauucggagccggcgcagcucuacagauacccuuugccaugcaaauggcguaucguuucaaugggauuggagucacucagaacguucuguacgaaaaucagaaacucaucgccaaccaguuuaauucugcuauuggcaagauccaagacagccugucaaguaccgcauccgcccuugguaaauugcaggaugugguaaaccagaaugcucaggcccugaacacguuagugaagcaacucucuagcaauuucggggcaauauccucaguccugaacgacauccuuagccggcuggauaagguggaggcggaaguucagauugaccgauugaucacaggaagacuccagagucugcaaaccuacgugacucagcagcuaauuagggccgcugagauccgcgccucugcaaaccuggcugccaccaaaauguccgagugcguccucggccagagcaagcggguggauuuuugugguaaaggcuaucaucugaugucguucccacaaucagcaccucacgggguuguguuucuucaugucacauacguacccgcccaggaaaagaauuucacuaccgcuccagcgauaugccacgagggaaaagcccacuuuccgagagaaggcguguucguuucuaacgggacacauugguuuauuacgcagaggaauuucuaugagccucagaucaucaccacugacaacacauuugugaguggauccugugaugucgugauuggcaucguaaauaacaccguguacgaccccuugcaaccagagcuggauagcuucaaggaagaguuagacaaauauuucaagaaucacacuucucccgaugucgaccucggugauauuagcgggauaaacgcauccguugugaauauccagaaggaaauugaccgccugaacgagguggcuaaaaaucuuaacgaaucacugaucgaccuacaggagcucggaaaguacgagcaguauauuaaauggccuugguacaucuggcugggcuuuauagccgguuugaucgccauuaucauggucacaauuaugcugugcuguaugaccaguugcuguagcugcuuaaagggcuguugcucuuguggguccugcugcaaauucgaugaagacgauucagagccagugcucaagggaguuaagcugcauuacacguga

SEQ ID NO: 12033 - RNA, 3798 nt, Artificial Sequence
  SARS-CoV-2/pangolin/Guangxi/P1E/2017__EPI_ISL_410539 spike protein CDS human (1-1265)
auguucguguuucuguucguccucccccuuguuagcucccagugcgugaaccugaccacaagaacuggcauccaaccuggguacaccaauucuucaacgaggggaguauauuacccagacaagguguuucggaguagcauuuugcacuuaacacaggaucuguuccuaccguuuuucuccaacgucacuugguuuaauaccauaaacuaucaggguggcuucaagaaguuugacaaucccgugcucccuuucaacgaugggguuuacuuugccucuacagagaaaucgaauaucauucgcggauggaucuucggcaccacucuggacgcucgaacacagucacuucugauugugaacaaugcaaccaacgucgugaucaagguaugugaauuucaauucugcacggauccauucuuggguguuuauuaccauaauaacaauaaaacuuggguggagaacgaauuucgugucuauagcagugccaauaacuguaccuucgaguacauaucccagcccuuucucauggaccuggaagggaagcagggaaacuucaagaaucugagagaguuuguguucaaaaacguggauggcuacuuuaagaucuauucuaaacacacaccuauugaccucgucagggauuuaccacggggcuucgcggcucuggagccccuuguugacuugccuaucgggauuaauaucacucgcuuucagacccugcuagcccuccauagaagcuaccugacaccaggaaaacuugaauccgguuggaccacgggcgcagccgcuuauuacgugggguaucugcaacagaggacuuucuugcucucauacaaccagaauggaacaauaaccgaugcaguagacugcagucuggauccguuaagcgagacuaaguguacacugaagucucucaccguggaaaagggcauuuaucagacguccaacuuucggguccaacccaccaucucaauugugcgcuucccuaauaucacaaaccuuugcccauuuggugagguuuucaaugccagcaaauucgcuaguguguacgccuggaaccgaaagagaaucucuaauugugucgcggacuacuccgugcuguauaacagcacuucguuuucuaccuucaaaugcuacgggguaucccccacaaaguugaaugaccuauguuuuacuaacguuuaugcagauucauucguggucaaaggagacgaggugaggcagauugccccuggccagaccggcgucauagcugauuacaauuauaagcugccagacgauuuuacagggugcgugaucgccuggaacaguguuaaacaagacgcacucaccggagguaacuaccuguaucggcuuuuccguaagagcaagcugaaacccuuugaacgcgauauuuccacugagaucuaccaggcuggcucuacgccguguaauggacaggugggguugaacugcuacuauccucucgaaagauacggcuuccaccccacaaccgguguaaauuaucagccauuuagggucgugguucugagcuucgaguuacugaacgggccugccacugugugcggccccaagcuaucaaccacacucgucaaagacaagugugugaauuuuaacuucaauggacugaccggcacugggguacuuacaacgaguaaaaagcaauuuuugccauuccagcaguucggacgggauauauccgacaccacugaugcggugcgagacccccagacacuggaaauucucgacaucaccccuugcagcuuugguggcguuucugucaucacaccagggacuaacaccucaaaucaaguggccgugcuguaccaggaugucaacuguacggagguuccgauggcaauucaugcugagcagcuuacccccgccuggcgcguguauagugcuggagccaauguguuccagacaagagcaggcugccugguaggugccgaacacgucaacaauagcuacgagugugacaucccugugggggcuggcauuugcgcguccuaucacucuaugucgagcuugagguccguuaaccaacggucaauaaucgcauacacuaugagucucggagccgaaaauucuguggcuuacagcaacaacuccauugccaucccaaccaauuuuacaaucucagucacuaccgagauucugcccgugagcaugacgaagacaucuguugauuguaccauguauauaugcggcgacuccaucgaauguaguaacuuacugcuacaguacgggagcuucugcacucagcucaaucgcgcacugacaggaauugccguggagcaggauaaaaacacccaagagguauuugcucaggucaagcagaucuauaaaacuccuccaauuaaggacuucgguggcuuuaauuucucucaaauccuucccgauccguccaaaccuucaaagagaaguuuuauagaagacuugcuguucaacaaggugacccucgccgaugcaggguuuaucaaacaguacggagacugucugggcgauauugcggcuagggacuuaaucugcgcccagaaguucaauggucugacagugcuuccacccuugcucacggaugagaugauugcacaguauaccagcgcccugcuagcugggacuaucacaucgggcuggaccuucggagccggcgcagcucugcaaauaccuuuugccaugcagauggcguaccguuucaacgggauuggagucacacagaauguucucuaugaaaaccagaaacugaucgccaaucaauuuaacuccgcuauuggcaagauccaggacucucuuagcucaacugcaagugccuuggguaaacugcaggacgugguaaaucagaacgcucaagccuuaaauacccucgugaagcagcuguccucuaacuucggggcaauaagcuccguccuuaacgauauccugucacgguuggacaagguggaggcggaaguucagauugaucgacucaucacgggaagacugcaaagccuacagacauacgugacccagcagcugauuagggccgcugagauccgcgccagugcaaaucucgcugccacuaaaaugucugagugcguccugggccaauccaagcggguggacuuuugugguaaaggcuaccaucuuaugagcuucccccagucggcaccacacgggguuguguuuuugcaugucaccuauguaccugcccaggaaaagaacuucacaacugcucccgcgauaugccacgagggaaaagcccacuuuccaagagaaggcguguucguuucaaaugggacccauugguuuauuacacagaggaacuucuacgagccgcaaaucaucacgaccgauaauacuuuugugucuggaaguugugacgucgugauuggcaucguaaacaauacaguguaugauccucugcagcccgaguuagacuccuucaaggaggaacucgauaaauacuucaagaaccacaccagcccagacgucgaucugggugacauuucugggauaaaugcaagcguugugaacauccagaaggaaauugaucgccuuaaugagguggcuaaaaaccugaaugaaucccuaaucgaccuccaggagcugggaaaguaugagcaauacauuaaauggcccugguauaucugguugggcuuuauagccggucugaucgccauuaucauggucacuauuauguuaugcuguaugacaucaugcuguaguugccucaagggcuguugcagcugugggucuugcugcaaauucgacgaagaugacuccgagccugugcugaagggaguuaaacuucauuacaccuga

SEQ ID NO: 12034 - RNA, 3822 nt, Artificial Sequence
  SARS-CoV-2/Wuhan/WIV05/2019__EPI_ISL_402128 spike protein CDS gc mod (1-1273)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12035 - RNA, 3822 nt, Artificial Sequence; identical to SEQ ID NO: 146
  SARS-CoV-2/Wuhan/WIV05/2019__EPI_ISL_402128 spike protein CDS gc mod (1-1273)(K986P_V987P)

SEQ ID NO: 12036 - RNA, 3822 nt, Artificial Sequence
  SARS-CoV-2/Wuhan/WIV05/2019__EPI_ISL_402128 spike protein CDS gc mod (1-1273)(K986P_V987P_T887WN_A1020W)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12037 - RNA, 3822 nt, Artificial Sequence
  SARS-CoV-2/Wuhan/WIV05/2019__EPI_ISL_402128 spike protein CDS gc mod (1-1273)(K986P_V987P_P1069F)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12038 - RNA, 3822 nt, Artificial Sequence
  SARS-CoV-2/Wuhan/WIV05/2019__EPI_ISL_402128 spike protein CDS gc mod (1-1273)(K986P_V987P_ H1048Q_H1064N_ H1083N_H1101N)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12039 - RNA, 3822 nt, Artificial Sequence
  SARS-CoV-2/Wuhan/WIV05/2019__EPI_ISL_402128 spike protein CDS gc mod (1-1273)(I712C_T1077C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12040 - RNA, 3822 nt, Artificial Sequence
  SARS-CoV-2/Wuhan/WIV05/2019__EPI_ISL_402128 spike protein CDS gc mod (1-1273)(I714C_Y1110C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12041 - RNA, 3822 nt, Artificial Sequence
  SARS-CoV-2/Wuhan/WIV05/2019__EPI_ISL_402128 spike protein CDS gc mod (1-1273)(P715C_P1069C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12042 - RNA, 3822 nt, Artificial Sequence
  SARS-CoV-2/Wuhan/WIV05/2019__EPI_ISL_402128 spike protein CDS gc mod (1-1273)(G889C_L1034C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12043 - RNA, 3822 nt, Artificial Sequence
  SARS-CoV-2/Wuhan/WIV05/2019__EPI_ISL_402128 spike protein CDS gc mod (1-1273)(I909C_Y1047C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12044 - RNA, 3822 nt, Artificial Sequence
  SARS-CoV-2/Wuhan/WIV05/2019__EPI_ISL_402128 spike protein CDS gc mod (1-1273)(Q965C_S1003C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12045 - RNA, 3822 nt, Artificial Sequence
  SARS-CoV-2/Wuhan/WIV05/2019__EPI_ISL_402128 spike protein CDS gc mod (1-1273)(F970C_G999C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12046 - RNA, 3822 nt, Artificial Sequence
  SARS-CoV-2/Wuhan/WIV05/2019__EPI_ISL_402128 spike protein CDS gc mod (1-1273)(A972C_R995C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12047 - RNA, 3822 nt, Artificial Sequence
  SARS-CoV-2/Wuhan/WIV05/2019__EPI_ISL_402128 spike protein CDS gc mod (1-1273)(A890C_V1040C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12048 - RNA, 3822 nt, Artificial Sequence
  SARS-CoV-2/Wuhan/WIV05/2019__EPI_ISL_402128 spike protein CDS gc mod (1-1273)(T874C_S1055C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12049 - RNA, 2046 nt, Artificial Sequence; identical to SEQ ID NO: 147
  SARS-CoV-2/Wuhan/WIV05/2019__EPI_ISL_402128 spike protein CDS gc mod (1-681)

SEQ ID NO: 12050 - RNA, 1776 nt, Artificial Sequence
  SARS-CoV-2/Wuhan/WIV05/2019__EPI_ISL_402128 spike protein CDS gc mod (682-1273)
agacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacc

SEQ ID NO: 12051 - RNA, 45 nt, Artificial Sequence
  SARS-CoV-2/Wuhan/WIV05/2019__EPI_ISL_402128 spike protein CDS gc mod (1-15)
auguucguguuucuggugcugcugccccugguguccagccagugu

SEQ ID NO: 12052 - RNA, 1998 nt, Artificial Sequence
  SARS-CoV-2/Wuhan/WIV05/2019__EPI_ISL_402128 spike protein CDS gc mod (16-681)
gugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagcccc

SEQ ID NO: 12053 - RNA, 189 nt, Artificial Sequence
  SARS-CoV-2/Wuhan/WIV05/2019__EPI_ISL_402128 spike protein CDS gc mod (1212-1273)
uggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccuga

SEQ ID NO: 12054 - RNA, 3633 nt, Artificial Sequence
  SARS-CoV-2/Wuhan/WIV05/2019__EPI_ISL_402128 spike protein CDS gc mod (1-1211)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12055 - RNA, 3633 nt, Artificial Sequence
  SARS-CoV-2/Wuhan/WIV05/2019__EPI_ISL_402128 spike protein CDS gc mod (1-1211)(K986P_V987P)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12056 - RNA, 3633 nt, Artificial Sequence
  SARS-CoV-2/Wuhan/WIV05/2019__EPI_ISL_402128 spike protein CDS gc mod (1-1211)(K986P_V987P_T887WN_A1020W)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12057 - RNA, 3633 nt, Artificial Sequence
  SARS-CoV-2/Wuhan/WIV05/2019__EPI_ISL_402128 spike protein CDS gc mod (1-1211)(K986P_V987P_P1069F)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12058 - RNA, 3633 nt, Artificial Sequence
  SARS-CoV-2/Wuhan/WIV05/2019__EPI_ISL_402128 spike protein CDS gc mod (1-1211)(K986P_V987P_ H1048Q_H1064N_ H1083N_H1101N)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12059 - RNA, 3633 nt, Artificial Sequence
  SARS-CoV-2/Wuhan/WIV05/2019__EPI_ISL_402128 spike protein CDS gc mod (1-1211)(I712C_T1077C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12060 - RNA, 3633 nt, Artificial Sequence
  SARS-CoV-2/Wuhan/WIV05/2019__EPI_ISL_402128 spike protein CDS gc mod (1-1211)(I714C_Y1110C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12061 - RNA, 3633 nt, Artificial Sequence
  SARS-CoV-2/Wuhan/WIV05/2019__EPI_ISL_402128 spike protein CDS gc mod (1-1211)(P715C_P1069C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12062 - RNA, 3633 nt, Artificial Sequence
  SARS-CoV-2/Wuhan/WIV05/2019__EPI_ISL_402128 spike protein CDS gc mod (1-1211)(G889C_L1034C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12063 - RNA, 3633 nt, Artificial Sequence
  SARS-CoV-2/Wuhan/WIV05/2019__EPI_ISL_402128 spike protein CDS gc mod (1-1211)(I909C_Y1047C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12064 - RNA, 3633 nt, Artificial Sequence
  SARS-CoV-2/Wuhan/WIV05/2019__EPI_ISL_402128 spike protein CDS gc mod (1-1211)(Q965C_S1003C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12065 - RNA, 3633 nt, Artificial Sequence
  SARS-CoV-2/Wuhan/WIV05/2019__EPI_ISL_402128 spike protein CDS gc mod (1-1211)(F970C_G999C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12066 - RNA, 3633 nt, Artificial Sequence
  SARS-CoV-2/Wuhan/WIV05/2019__EPI_ISL_402128 spike protein CDS gc mod (1-1211)(A972C_R995C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12067 - RNA, 3633 nt, Artificial Sequence
  SARS-CoV-2/Wuhan/WIV05/2019__EPI_ISL_402128 spike protein CDS gc mod (1-1211)(A890C_V1040C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12068 - RNA, 3633 nt, Artificial Sequence
  SARS-CoV-2/Wuhan/WIV05/2019__EPI_ISL_402128 spike protein CDS gc mod (1-1211)(T874C_S1055C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaag

SEQ ID NO: 12069 - RNA, 3441 nt, Artificial Sequence
  SARS-CoV-2/Wuhan/WIV05/2019__EPI_ISL_402128 spike protein CDS gc mod (1-1147)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12070 - RNA, 3441 nt, Artificial Sequence
  SARS-CoV-2/Wuhan/WIV05/2019__EPI_ISL_402128 spike protein CDS gc mod (1-1147)(K986P_V987P)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12071 - RNA, 3441 nt, Artificial Sequence
  SARS-CoV-2/Wuhan/WIV05/2019__EPI_ISL_402128 spike protein CDS gc mod (1-1147)(K986P_V987P_T887WN_A1020W)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12072 - RNA, 3441 nt, Artificial Sequence
  SARS-CoV-2/Wuhan/WIV05/2019__EPI_ISL_402128 spike protein CDS gc mod (1-1147)(K986P_V987P_P1069F)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12073 - RNA, 3441 nt, Artificial Sequence
  SARS-CoV-2/Wuhan/WIV05/2019__EPI_ISL_402128 spike protein CDS gc mod (1-1147)(K986P_V987P_ H1048Q_H1064N_ H1083N_H1101N)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12074 - RNA, 3441 nt, Artificial Sequence
  SARS-CoV-2/Wuhan/WIV05/2019__EPI_ISL_402128 spike protein CDS gc mod (1-1147)(I712C_T1077C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12075 - RNA, 3441 nt, Artificial Sequence
  SARS-CoV-2/Wuhan/WIV05/2019__EPI_ISL_402128 spike protein CDS gc mod (1-1147)(I714C_Y1110C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagc

SEQ ID NO: 12076 - RNA, 3441 nt, Artificial Sequence
  SARS-CoV-2/Wuhan/WIV05/2019__EPI_ISL_402128 spike protein CDS gc mod (1-1147)(P715C_P1069C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12077 - RNA, 3441 nt, Artificial Sequence
  SARS-CoV-2/Wuhan/WIV05/2019__EPI_ISL_402128 spike protein CDS gc mod (1-1147)(G889C_L1034C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12078 - RNA, 3441 nt, Artificial Sequence
  SARS-CoV-2/Wuhan/WIV05/2019__EPI_ISL_402128 spike protein CDS gc mod (1-1147)(I909C_Y1047C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12079 - RNA, 3441 nt, Artificial Sequence
  SARS-CoV-2/Wuhan/WIV05/2019__EPI_ISL_402128 spike protein CDS gc mod (1-1147)(Q965C_S1003C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12080 - RNA, 3441 nt, Artificial Sequence
  SARS-CoV-2/Wuhan/WIV05/2019__EPI_ISL_402128 spike protein CDS gc mod (1-1147)(F970C_G999C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12081 - RNA, 3441 nt, Artificial Sequence
  SARS-CoV-2/Wuhan/WIV05/2019__EPI_ISL_402128 spike protein CDS gc mod (1-1147)(A972C_R995C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12082 - RNA, 3441 nt, Artificial Sequence
  SARS-CoV-2/Wuhan/WIV05/2019__EPI_ISL_402128 spike protein CDS gc mod (1-1147)(A890C_V1040C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12083 - RNA, 3441 nt, Artificial Sequence
  SARS-CoV-2/Wuhan/WIV05/2019__EPI_ISL_402128 spike protein CDS gc mod (1-1147)(T874C_S1055C)
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagc

SEQ ID NO: 12084 - RNA, 4116 nt, Artificial Sequence
  SARS-CoV-2/Wuhan/WIV05/2019__EPI_ISL_402128 spike protein CDS gc mod (1-1211) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12085 - RNA, 4116 nt, Artificial Sequence
  SARS-CoV-2/Wuhan/WIV05/2019__EPI_ISL_402128 spike protein CDS gc mod (1-1211)(K986P_V987P) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12086 - RNA, 4116 nt, Artificial Sequence
  SARS-CoV-2/Wuhan/WIV05/2019__EPI_ISL_402128 spike protein CDS gc mod (1-1211)(K986P_V987P_T887WN_A1020W) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12087 - RNA, 4116 nt, Artificial Sequence
  SARS-CoV-2/Wuhan/WIV05/2019__EPI_ISL_402128 spike protein CDS gc mod (1-1211)(K986P_V987P_P1069F) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12088 - RNA, 4116 nt, Artificial Sequence
  SARS-CoV-2/Wuhan/WIV05/2019__EPI_ISL_402128 spike protein CDS gc mod (1-1211)(K986P_V987P_ H1048Q_H1064N_ H1083N_H1101N) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12089 - RNA, 4116 nt, Artificial Sequence
  SARS-CoV-2/Wuhan/WIV05/2019__EPI_ISL_402128 spike protein CDS gc mod (1-1211)(I712C_T1077C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12090 - RNA, 4116 nt, Artificial Sequence
  SARS-CoV-2/Wuhan/WIV05/2019__EPI_ISL_402128 spike protein CDS gc mod (1-1211)(I714C_Y1110C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12091 - RNA, 4116 nt, Artificial Sequence
  SARS-CoV-2/Wuhan/WIV05/2019__EPI_ISL_402128 spike protein CDS gc mod (1-1211)(P715C_P1069C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12092 - RNA, 4116 nt, Artificial Sequence
  SARS-CoV-2/Wuhan/WIV05/2019__EPI_ISL_402128 spike protein CDS gc mod (1-1211)(G889C_L1034C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12093 - RNA, 4116 nt, Artificial Sequence
  SARS-CoV-2/Wuhan/WIV05/2019__EPI_ISL_402128 spike protein CDS gc mod (1-1211)(I909C_Y1047C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12094 - RNA, 4116 nt, Artificial Sequence
  SARS-CoV-2/Wuhan/WIV05/2019__EPI_ISL_402128 spike protein CDS gc mod (1-1211)(Q965C_S1003C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12095 - RNA, 4116 nt, Artificial Sequence
  SARS-CoV-2/Wuhan/WIV05/2019__EPI_ISL_402128 spike protein CDS gc mod (1-1211)(F970C_G999C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12096 - RNA, 4116 nt, Artificial Sequence
  SARS-CoV-2/Wuhan/WIV05/2019__EPI_ISL_402128 spike protein CDS gc mod (1-1211)(A972C_R995C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12097 - RNA, 4116 nt, Artificial Sequence
  SARS-CoV-2/Wuhan/WIV05/2019__EPI_ISL_402128 spike protein CDS gc mod (1-1211)(A890C_V1040C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12098 - RNA, 4116 nt, Artificial Sequence
  SARS-CoV-2/Wuhan/WIV05/2019__EPI_ISL_402128 spike protein CDS gc mod (1-1211)(T874C_S1055C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12099 - RNA, 4140 nt, Artificial Sequence
  SARS-CoV-2/Wuhan/WIV05/2019__EPI_ISL_402128 spike protein CDS gc mod (1-1211) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12100 - RNA, 4140 nt, Artificial Sequence
  SARS-CoV-2/Wuhan/WIV05/2019__EPI_ISL_402128 spike protein CDS gc mod (1-1211)(K986P_V987P) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12101 - RNA, 4140 nt, Artificial Sequence
  SARS-CoV-2/Wuhan/WIV05/2019__EPI_ISL_402128 spike protein CDS gc mod (1-1211)(K986P_V987P_T887WN_A1020W) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12102 - RNA, 4140 nt, Artificial Sequence
  SARS-CoV-2/Wuhan/WIV05/2019__EPI_ISL_402128 spike protein CDS gc mod (1-1211)(K986P_V987P_P1069F) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12103 - RNA, 4140 nt, Artificial Sequence
  SARS-CoV-2/Wuhan/WIV05/2019__EPI_ISL_402128 spike protein CDS gc mod (1-1211)(K986P_V987P_ H1048Q_H1064N_ H1083N_H1101N) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12104 - RNA, 4140 nt, Artificial Sequence
  SARS-CoV-2/Wuhan/WIV05/2019__EPI_ISL_402128 spike protein CDS gc mod (1-1211)(I712C_T1077C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12105 - RNA, 4140 nt, Artificial Sequence
  SARS-CoV-2/Wuhan/WIV05/2019__EPI_ISL_402128 spike protein CDS gc mod (1-1211)(I714C_Y1110C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12106 - RNA, 4140 nt, Artificial Sequence
  SARS-CoV-2/Wuhan/WIV05/2019__EPI_ISL_402128 spike protein CDS gc mod (1-1211)(P715C_P1069C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12107 - RNA, 4140 nt, Artificial Sequence
  SARS-CoV-2/Wuhan/WIV05/2019__EPI_ISL_402128 spike protein CDS gc mod (1-1211)(G889C_L1034C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12108 - RNA, 4140 nt, Artificial Sequence
  SARS-CoV-2/Wuhan/WIV05/2019__EPI_ISL_402128 spike protein CDS gc mod (1-1211)(I909C_Y1047C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12109 - RNA, 4140 nt, Artificial Sequence
  SARS-CoV-2/Wuhan/WIV05/2019__EPI_ISL_402128 spike protein CDS gc mod (1-1211)(Q965C_S1003C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12110 - RNA, 4140 nt, Artificial Sequence
  SARS-CoV-2/Wuhan/WIV05/2019__EPI_ISL_402128 spike protein CDS gc mod (1-1211)(F970C_G999C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12111 - RNA, 4140 nt, Artificial Sequence
  SARS-CoV-2/Wuhan/WIV05/2019__EPI_ISL_402128 spike protein CDS gc mod (1-1211)(A972C_R995C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12112 - RNA, 4140 nt, Artificial Sequence
  SARS-CoV-2/Wuhan/WIV05/2019__EPI_ISL_402128 spike protein CDS gc mod (1-1211)(A890C_V1040C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12113 - RNA, 4140 nt, Artificial Sequence
  SARS-CoV-2/Wuhan/WIV05/2019__EPI_ISL_402128 spike protein CDS gc mod (1-1211)(T874C_S1055C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12114 - RNA, 3726 nt, Artificial Sequence
  SARS-CoV-2/Wuhan/WIV05/2019__EPI_ISL_402128 spike protein CDS gc mod (1-1211) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12115 - RNA, 3726 nt, Artificial Sequence
  SARS-CoV-2/Wuhan/WIV05/2019__EPI_ISL_402128 spike protein CDS gc mod (1-1211)(K986P_V987P) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12116 - RNA, 3726 nt, Artificial Sequence
  SARS-CoV-2/Wuhan/WIV05/2019__EPI_ISL_402128 spike protein CDS gc mod (1-1211)(K986P_V987P_T887WN_A1020W) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12117 - RNA, 3726 nt, Artificial Sequence
  SARS-CoV-2/Wuhan/WIV05/2019__EPI_ISL_402128 spike protein CDS gc mod (1-1211)(K986P_V987P_P1069F) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12118 - RNA, 3726 nt, Artificial Sequence
  SARS-CoV-2/Wuhan/WIV05/2019__EPI_ISL_402128 spike protein CDS gc mod (1-1211)(K986P_V987P_ H1048Q_H1064N_ H1083N_H1101N) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12119 - RNA, 3726 nt, Artificial Sequence
  SARS-CoV-2/Wuhan/WIV05/2019__EPI_ISL_402128 spike protein CDS gc mod (1-1211)(I712C_T1077C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12120 - RNA, 3726 nt, Artificial Sequence
  SARS-CoV-2/Wuhan/WIV05/2019__EPI_ISL_402128 spike protein CDS gc mod (1-1211)(I714C_Y1110C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12121 - RNA, 3726 nt, Artificial Sequence
  SARS-CoV-2/Wuhan/WIV05/2019__EPI_ISL_402128 spike protein CDS gc mod (1-1211)(P715C_P1069C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12122 - RNA, 3726 nt, Artificial Sequence
  SARS-CoV-2/Wuhan/WIV05/2019__EPI_ISL_402128 spike protein CDS gc mod (1-1211)(G889C_L1034C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12123 - RNA, 3726 nt, Artificial Sequence
  SARS-CoV-2/Wuhan/WIV05/2019__EPI_ISL_402128 spike protein CDS gc mod (1-1211)(I909C_Y1047C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12124 - RNA, 3726 nt, Artificial Sequence
  SARS-CoV-2/Wuhan/WIV05/2019__EPI_ISL_402128 spike protein CDS gc mod (1-1211)(Q965C_S1003C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12125 - RNA, 3726 nt, Artificial Sequence
  SARS-CoV-2/Wuhan/WIV05/2019__EPI_ISL_402128 spike protein CDS gc mod (1-1211)(F970C_G999C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12126 - RNA, 3726 nt, Artificial Sequence
  SARS-CoV-2/Wuhan/WIV05/2019__EPI_ISL_402128 spike protein CDS gc mod (1-1211)(A972C_R995C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12127 - RNA, 3726 nt, Artificial Sequence
  SARS-CoV-2/Wuhan/WIV05/2019__EPI_ISL_402128 spike protein CDS gc mod (1-1211)(A890C_V1040C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12128 - RNA, 3726 nt, Artificial Sequence
  SARS-CoV-2/Wuhan/WIV05/2019__EPI_ISL_402128 spike protein CDS gc mod (1-1211)(T874C_S1055C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuuga

SEQ ID NO: 12129 - RNA, 4098 nt, Artificial Sequence
  SARS-CoV-2/Wuhan/WIV05/2019__EPI_ISL_402128 spike protein CDS gc mod (1-1211) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12130 - RNA, 4098 nt, Artificial Sequence
  SARS-CoV-2/Wuhan/WIV05/2019__EPI_ISL_402128 spike protein CDS gc mod (1-1211)(K986P_V987P) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12131 - RNA, 4098 nt, Artificial Sequence
  SARS-CoV-2/Wuhan/WIV05/2019__EPI_ISL_402128 spike protein CDS gc mod (1-1211)(K986P_V987P_T887WN_A1020W) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12132 - RNA, 4098 nt, Artificial Sequence
  SARS-CoV-2/Wuhan/WIV05/2019__EPI_ISL_402128 spike protein CDS gc mod (1-1211)(K986P_V987P_P1069F) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12133 - RNA, 4098 nt, Artificial Sequence
  SARS-CoV-2/Wuhan/WIV05/2019__EPI_ISL_402128 spike protein CDS gc mod (1-1211)(K986P_V987P_ H1048Q_H1064N_ H1083N_H1101N) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12134 - RNA, 4098 nt, Artificial Sequence
  SARS-CoV-2/Wuhan/WIV05/2019__EPI_ISL_402128 spike protein CDS gc mod (1-1211)(I712C_T1077C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12135 - RNA, 4098 nt, Artificial Sequence
  SARS-CoV-2/Wuhan/WIV05/2019__EPI_ISL_402128 spike protein CDS gc mod (1-1211)(I714C_Y1110C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12136 - RNA, 4098 nt, Artificial Sequence
  SARS-CoV-2/Wuhan/WIV05/2019__EPI_ISL_402128 spike protein CDS gc mod (1-1211)(P715C_P1069C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12137 - RNA, 4098 nt, Artificial Sequence
  SARS-CoV-2/Wuhan/WIV05/2019__EPI_ISL_402128 spike protein CDS gc mod (1-1211)(G889C_L1034C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12138 - RNA, 4098 nt, Artificial Sequence
  SARS-CoV-2/Wuhan/WIV05/2019__EPI_ISL_402128 spike protein CDS gc mod (1-1211)(I909C_Y1047C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12139 - RNA, 4098 nt, Artificial Sequence
  SARS-CoV-2/Wuhan/WIV05/2019__EPI_ISL_402128 spike protein CDS gc mod (1-1211)(Q965C_S1003C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12140 - RNA, 4098 nt, Artificial Sequence
  SARS-CoV-2/Wuhan/WIV05/2019__EPI_ISL_402128 spike protein CDS gc mod (1-1211)(F970C_G999C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12141 - RNA, 4098 nt, Artificial Sequence
  SARS-CoV-2/Wuhan/WIV05/2019__EPI_ISL_402128 spike protein CDS gc mod (1-1211)(A972C_R995C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12142 - RNA, 4098 nt, Artificial Sequence
  SARS-CoV-2/Wuhan/WIV05/2019__EPI_ISL_402128 spike protein CDS gc mod (1-1211)(A890C_V1040C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12143 - RNA, 4098 nt, Artificial Sequence
  SARS-CoV-2/Wuhan/WIV05/2019__EPI_ISL_402128 spike protein CDS gc mod (1-1211)(T874C_S1055C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12144 - RNA, 3924 nt, Artificial Sequence
  SARS-CoV-2/Wuhan/WIV05/2019__EPI_ISL_402128 spike protein CDS gc mod (1-1147) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12145 - RNA, 3924 nt, Artificial Sequence
  SARS-CoV-2/Wuhan/WIV05/2019__EPI_ISL_402128 spike protein CDS gc mod (1-1147)(K986P_V987P) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12146 - RNA, 3924 nt, Artificial Sequence
  SARS-CoV-2/Wuhan/WIV05/2019__EPI_ISL_402128 spike protein CDS gc mod (1-1147)(K986P_V987P_T887WN_A1020W) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12147 - RNA, 3924 nt, Artificial Sequence
  SARS-CoV-2/Wuhan/WIV05/2019__EPI_ISL_402128 spike protein CDS gc mod (1-1147)(K986P_V987P_P1069F) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12148 - RNA, 3924 nt, Artificial Sequence
  SARS-CoV-2/Wuhan/WIV05/2019__EPI_ISL_402128 spike protein CDS gc mod (1-1147)(K986P_V987P_ H1048Q_H1064N_ H1083N_H1101N) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12149 - RNA, 3924 nt, Artificial Sequence
  SARS-CoV-2/Wuhan/WIV05/2019__EPI_ISL_402128 spike protein CDS gc mod (1-1147)(I712C_T1077C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12150 - RNA, 3924 nt, Artificial Sequence
  SARS-CoV-2/Wuhan/WIV05/2019__EPI_ISL_402128 spike protein CDS gc mod (1-1147)(I714C_Y1110C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12151 - RNA, 3924 nt, Artificial Sequence
  SARS-CoV-2/Wuhan/WIV05/2019__EPI_ISL_402128 spike protein CDS gc mod (1-1147)(P715C_P1069C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12152 - RNA, 3924 nt, Artificial Sequence
  SARS-CoV-2/Wuhan/WIV05/2019__EPI_ISL_402128 spike protein CDS gc mod (1-1147)(G889C_L1034C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12153 - RNA, 3924 nt, Artificial Sequence
  SARS-CoV-2/Wuhan/WIV05/2019__EPI_ISL_402128 spike protein CDS gc mod (1-1147)(I909C_Y1047C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12154 - RNA, 3924 nt, Artificial Sequence
  SARS-CoV-2/Wuhan/WIV05/2019__EPI_ISL_402128 spike protein CDS gc mod (1-1147)(Q965C_S1003C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12155 - RNA, 3924 nt, Artificial Sequence
  SARS-CoV-2/Wuhan/WIV05/2019__EPI_ISL_402128 spike protein CDS gc mod (1-1147)(F970C_G999C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12156 - RNA, 3924 nt, Artificial Sequence
  SARS-CoV-2/Wuhan/WIV05/2019__EPI_ISL_402128 spike protein CDS gc mod (1-1147)(A972C_R995C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12157 - RNA, 3924 nt, Artificial Sequence
  SARS-CoV-2/Wuhan/WIV05/2019__EPI_ISL_402128 spike protein CDS gc mod (1-1147)(A890C_V1040C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12158 - RNA, 3924 nt, Artificial Sequence
  SARS-CoV-2/Wuhan/WIV05/2019__EPI_ISL_402128 spike protein CDS gc mod (1-1147)(T874C_S1055C) LumSynth construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcgguga

SEQ ID NO: 12159 - RNA, 3948 nt, Artificial Sequence
  SARS-CoV-2/Wuhan/WIV05/2019__EPI_ISL_402128 spike protein CDS gc mod (1-1147) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12160 - RNA, 3948 nt, Artificial Sequence
  SARS-CoV-2/Wuhan/WIV05/2019__EPI_ISL_402128 spike protein CDS gc mod (1-1147)(K986P_V987P) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12161 - RNA, 3948 nt, Artificial Sequence
  SARS-CoV-2/Wuhan/WIV05/2019__EPI_ISL_402128 spike protein CDS gc mod (1-1147)(K986P_V987P_T887WN_A1020W) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12162 - RNA, 3948 nt, Artificial Sequence
  SARS-CoV-2/Wuhan/WIV05/2019__EPI_ISL_402128 spike protein CDS gc mod (1-1147)(K986P_V987P_P1069F) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12163 - RNA, 3948 nt, Artificial Sequence
  SARS-CoV-2/Wuhan/WIV05/2019__EPI_ISL_402128 spike protein CDS gc mod (1-1147)(K986P_V987P_ H1048Q_H1064N_ H1083N_H1101N) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12164 - RNA, 3948 nt, Artificial Sequence
  SARS-CoV-2/Wuhan/WIV05/2019__EPI_ISL_402128 spike protein CDS gc mod (1-1147)(I712C_T1077C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12165 - RNA, 3948 nt, Artificial Sequence
  SARS-CoV-2/Wuhan/WIV05/2019__EPI_ISL_402128 spike protein CDS gc mod (1-1147)(I714C_Y1110C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12166 - RNA, 3948 nt, Artificial Sequence
  SARS-CoV-2/Wuhan/WIV05/2019__EPI_ISL_402128 spike protein CDS gc mod (1-1147)(P715C_P1069C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12167 - RNA, 3948 nt, Artificial Sequence
  SARS-CoV-2/Wuhan/WIV05/2019__EPI_ISL_402128 spike protein CDS gc mod (1-1147)(G889C_L1034C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12168 - RNA, 3948 nt, Artificial Sequence
  SARS-CoV-2/Wuhan/WIV05/2019__EPI_ISL_402128 spike protein CDS gc mod (1-1147)(I909C_Y1047C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12169 - RNA, 3948 nt, Artificial Sequence
  SARS-CoV-2/Wuhan/WIV05/2019__EPI_ISL_402128 spike protein CDS gc mod (1-1147)(Q965C_S1003C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12170 - RNA, 3948 nt, Artificial Sequence
  SARS-CoV-2/Wuhan/WIV05/2019__EPI_ISL_402128 spike protein CDS gc mod (1-1147)(F970C_G999C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12171 - RNA, 3948 nt, Artificial Sequence
  SARS-CoV-2/Wuhan/WIV05/2019__EPI_ISL_402128 spike protein CDS gc mod (1-1147)(A972C_R995C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12172 - RNA, 3948 nt, Artificial Sequence
  SARS-CoV-2/Wuhan/WIV05/2019__EPI_ISL_402128 spike protein CDS gc mod (1-1147)(A890C_V1040C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12173 - RNA, 3948 nt, Artificial Sequence
  SARS-CoV-2/Wuhan/WIV05/2019__EPI_ISL_402128 spike protein CDS gc mod (1-1147)(T874C_S1055C) Ferritin construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcuga

SEQ ID NO: 12174 - RNA, 3534 nt, Artificial Sequence
  SARS-CoV-2/Wuhan/WIV05/2019__EPI_ISL_402128 spike protein CDS gc mod (1-1147) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12175 - RNA, 3534 nt, Artificial Sequence
  SARS-CoV-2/Wuhan/WIV05/2019__EPI_ISL_402128 spike protein CDS gc mod (1-1147)(K986P_V987P) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12176 - RNA, 3534 nt, Artificial Sequence
  SARS-CoV-2/Wuhan/WIV05/2019__EPI_ISL_402128 spike protein CDS gc mod (1-1147)(K986P_V987P_T887WN_A1020W) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12177 - RNA, 3534 nt, Artificial Sequence
  SARS-CoV-2/Wuhan/WIV05/2019__EPI_ISL_402128 spike protein CDS gc mod (1-1147)(K986P_V987P_P1069F) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12178 - RNA, 3534 nt, Artificial Sequence
  SARS-CoV-2/Wuhan/WIV05/2019__EPI_ISL_402128 spike protein CDS gc mod (1-1147)(K986P_V987P_ H1048Q_H1064N_ H1083N_H1101N) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12179 - RNA, 3534 nt, Artificial Sequence
  SARS-CoV-2/Wuhan/WIV05/2019__EPI_ISL_402128 spike protein CDS gc mod (1-1147)(I712C_T1077C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12180 - RNA, 3534 nt, Artificial Sequence
  SARS-CoV-2/Wuhan/WIV05/2019__EPI_ISL_402128 spike protein CDS gc mod (1-1147)(I714C_Y1110C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12181 - RNA, 3534 nt, Artificial Sequence
  SARS-CoV-2/Wuhan/WIV05/2019__EPI_ISL_402128 spike protein CDS gc mod (1-1147)(P715C_P1069C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12182 - RNA, 3534 nt, Artificial Sequence
  SARS-CoV-2/Wuhan/WIV05/2019__EPI_ISL_402128 spike protein CDS gc mod (1-1147)(G889C_L1034C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12183 - RNA, 3534 nt, Artificial Sequence
  SARS-CoV-2/Wuhan/WIV05/2019__EPI_ISL_402128 spike protein CDS gc mod (1-1147)(I909C_Y1047C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12184 - RNA, 3534 nt, Artificial Sequence
  SARS-CoV-2/Wuhan/WIV05/2019__EPI_ISL_402128 spike protein CDS gc mod (1-1147)(Q965C_S1003C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12185 - RNA, 3534 nt, Artificial Sequence
  SARS-CoV-2/Wuhan/WIV05/2019__EPI_ISL_402128 spike protein CDS gc mod (1-1147)(F970C_G999C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12186 - RNA, 3534 nt, Artificial Sequence
  SARS-CoV-2/Wuhan/WIV05/2019__EPI_ISL_402128 spike protein CDS gc mod (1-1147)(A972C_R995C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12187 - RNA, 3534 nt, Artificial Sequence
  SARS-CoV-2/Wuhan/WIV05/2019__EPI_ISL_402128 spike protein CDS gc mod (1-1147)(A890C_V1040C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12188 - RNA, 3534 nt, Artificial Sequence
  SARS-CoV-2/Wuhan/WIV05/2019__EPI_ISL_402128 spike protein CDS gc mod (1-1147)(T874C_S1055C) Foldon construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuuga

SEQ ID NO: 12189 - RNA, 3906 nt, Artificial Sequence
  SARS-CoV-2/Wuhan/WIV05/2019__EPI_ISL_402128 spike protein CDS gc mod (1-1147) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12190 - RNA, 3906 nt, Artificial Sequence
  SARS-CoV-2/Wuhan/WIV05/2019__EPI_ISL_402128 spike protein CDS gc mod (1-1147)(K986P_V987P) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12191 - RNA, 3906 nt, Artificial Sequence
  SARS-CoV-2/Wuhan/WIV05/2019__EPI_ISL_402128 spike protein CDS gc mod (1-1147)(K986P_V987P_T887WN_A1020W) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12192 - RNA, 3906 nt, Artificial Sequence
  SARS-CoV-2/Wuhan/WIV05/2019__EPI_ISL_402128 spike protein CDS gc mod (1-1147)(K986P_V987P_P1069F) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12193 - RNA, 3906 nt, Artificial Sequence
  SARS-CoV-2/Wuhan/WIV05/2019__EPI_ISL_402128 spike protein CDS gc mod (1-1147)(K986P_V987P_ H1048Q_H1064N_ H1083N_H1101N) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12194 - RNA, 3906 nt, Artificial Sequence
  SARS-CoV-2/Wuhan/WIV05/2019__EPI_ISL_402128 spike protein CDS gc mod (1-1147)(I712C_T1077C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12195 - RNA, 3906 nt, Artificial Sequence
  SARS-CoV-2/Wuhan/WIV05/2019__EPI_ISL_402128 spike protein CDS gc mod (1-1147)(I714C_Y1110C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12196 - RNA, 3906 nt, Artificial Sequence
  SARS-CoV-2/Wuhan/WIV05/2019__EPI_ISL_402128 spike protein CDS gc mod (1-1147)(P715C_P1069C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12197 - RNA, 3906 nt, Artificial Sequence
  SARS-CoV-2/Wuhan/WIV05/2019__EPI_ISL_402128 spike protein CDS gc mod (1-1147)(G889C_L1034C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12198 - RNA, 3906 nt, Artificial Sequence
  SARS-CoV-2/Wuhan/WIV05/2019__EPI_ISL_402128 spike protein CDS gc mod (1-1147)(I909C_Y1047C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12199 - RNA, 3906 nt, Artificial Sequence
  SARS-CoV-2/Wuhan/WIV05/2019__EPI_ISL_402128 spike protein CDS gc mod (1-1147)(Q965C_S1003C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12200 - RNA, 3906 nt, Artificial Sequence
  SARS-CoV-2/Wuhan/WIV05/2019__EPI_ISL_402128 spike protein CDS gc mod (1-1147)(F970C_G999C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12201 - RNA, 3906 nt, Artificial Sequence
  SARS-CoV-2/Wuhan/WIV05/2019__EPI_ISL_402128 spike protein CDS gc mod (1-1147)(A972C_R995C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12202 - RNA, 3906 nt, Artificial Sequence
  SARS-CoV-2/Wuhan/WIV05/2019__EPI_ISL_402128 spike protein CDS gc mod (1-1147)(A890C_V1040C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12203 - RNA, 3906 nt, Artificial Sequence
  SARS-CoV-2/Wuhan/WIV05/2019__EPI_ISL_402128 spike protein CDS gc mod (1-1147)(T874C_S1055C) WhcAg construct
auguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguuga

SEQ ID NO: 12204 - RNA, 4094 nt, Artificial Sequence
  SARS-CoV-2/Wuhan/WIV05/2019__EPI_ISL_402128 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12205 - RNA, 4082 nt, Artificial Sequence
  SARS-CoV-2/bat/Yunnan/RaTG13/2013__EPI_ISL_402131 spike protein mRNA wt (1-1269)
aggagagucccgcagucggcguccagcggcucugcuuguucgugugugugucguugcaggccuuauucaagcuuaccauguuuguuuuucuuguuuuauugccacuaguuucuagucaguguguuaaucuaacaacuagaacucaguuaccuccugcauacaccaacucauccacccguggugucuauuacccugacaaaguuuucagaucuucaguuuuacauuuaacucaggauuuguuuuuaccuuucuucuccaaugugaccugguuccaugcuauacauguuucagggaccaaugguauuaaaagguuugauaacccaguucugccauucaacgauggcgucuauuuugcuuccacugagaagucuaauauaauaagaggauggauuuuugguacuaccuuagauucgaagacccagucucuacuuauuguuaauaacgcuacuaauguuguuauuaaagucugugaauuucaauuuuguaaugauccauuuuuggguguuuauuaccacaaaaacaacaaaaguuggauggaaagugaguucagaguuuacucuagugcgaauaauugcacuuuugaguaugucucucagccuuuucuuauggaccuugaaggaaaacaggguaauuucaaaaaucuuagggaauucguguuuaagaauauugaugguuauuucaaaauauauucuaaacauacgccuauuaauuuagugcgugaucuucccccugguuuuucagcuuuagaaccauugguagaucugccaauagguauuaacaucacuagguuucaaacuuuacuugcuuuacauagaagcuauuugacuccuggugauucuucuucagguuggacagcuggugcugcagcuuauuauguggguuaucuucaaccaaggacuuuucuacuaaaauauaaugagaauggaaccauuacagaugcuguagacugugcacuugacccucuuucagaaacaaaguguacguuaaaauccuucacuguugaaaaaggaauuuaucaaaccucuaacuuuagaguccaaccaacagauucuauuguuagauucccaaauauuacaaacuuauguccuuuuggugaaguuuuuaacgccaccacauucgcaucaguuuaugcuuggaacagaaagagaauuagcaacuguguugcugauuacucuguccuauauaauuccacuucauuuucuaccuuuaaauguuauggagugucuccuacuaaauuaaaugaucucugcuuuacuaauguuuaugcagacucauuugugauuacaggugaugaagucagacaaauugcgccaggacaaacuggaaagauugcugacuacaauuauaaacuaccagaugauuuuacugguuguguuauagcuuggaauucuaagcauauugaugcaaaagagggcgguaauuuuaacuaucuuuaccgucucuuuagaaaagcuaaucuuaaacccuuugagagggauaucucaacugaaauuuaccaagcaggcagcaaaccuuguaauggucaaacuggucuaaauugcuacuacccacuuuauagauauggauuuuacccuacugaugguguuggucaccaaccuuauaggguaguaguacuuucuuuugaacuucuaaaugcaccagcaacuguuuguggaccuaagaagucuacuaacuugguuaaaaauaaaugugucaauuucaacuuuaaugguuuaacuggcacagguguccucacagagucuaauaaaaaguuucuaccuuuccaacaauuugguagagacauugcagacacuacugaugccguccgugauccacagacacuugagauucuugacauuacaccauguucuuuugguggugucaguguuauaacaccuggaacaaaugccucuaaccagguugcuguucuuuaucaggauguuaacugcacagaagucccuguugcuauccaugcagaccaacuuacucccacuuggcguguuuacuccacagguucuaauguuuuucaaacacgugcagguuguuuaauaggggcugaacaugucaauaacucguaugagugugacauaccuauuggugcaggaauaugcgccaguuaucagacucaaacuaauucacguaguguggccagucaaucuauuauugccuacacuaugucacuuggugcagaaaauucaguugcuuauucuaauaacucuauugccauaccuacaaauuuuacuauuagugugaccacugaaauucuaccugugucuaugacaaagacaucgguagacuguacaauguauauuuguggugauucaacugagugcagcaaccuuuuguugcaauaugguaguuuuugcacacaauuaaaucgugcuuuaacuggaauagcuguugaacaggacaaaaauacucaagaaguuuuugcucaaguuaaacaaauuuauaagacaccaccaauuaaagauuuuggugguuucaauuuuucacaaauauuaccagauccaucaaaaccaagcaagaggucauuuauugaggauuuacuuuucaauaaagugacacuugcugaugcuggcuucaucaaacaauauggugauugccuuggugauauugcugcuagggaucuuauuugugcucaaaaguucaauggccuuacuguucugccaccuuugcucacagaugaaaugaucgcucaauacacuucugcacuauuagcagguacaaucacuucugguuggacuuuuggugcaggugcugcuuuacaaauaccauuugccaugcaaauggcuuauagguuuaaugguauuggaguuacacagaauguucucuaugagaaccaaaaauugauugccaaccaguuuaauagugcuauuggcaaaauucaagacucacuuucuucuacagcaagugcacuuggaaaacuucaagauguugucaaccaaaaugcacaagcuuuaaacacgcuuguuaaacaacuuagcuccaauuuuggagcuauuucuagcguguuaaaugauauccuuucacgucucgacaaaguugaggcugaagugcagauugacagguugaucacaggcagacuucaaagcuugcagacauaugugacucaacaauuaauuagagcugcagaaaucagagcuucugccaaucuugcugcuacuaaaaugucagaguguguacucggacaaucaaaaagaguugauuuuuguggaaaaggcuaucaucuuaugucuuucccucagucagcaccucaugguguagucuucuugcaugugacauaugucccugcacaagaaaagaacuucacaacugcuccugccauuugucaugauggaaaagcacacuuuccacgugaagguguuuucguuucaaauggcacacacugguuuguuacacaaaggaauuuuuaugaaccacaaauuauuacaacagacaacacauuugucucugguagcugugauguuguaauaggaauugucaacaacacaguuuaugauccuuugcaaccagaacuugauucauucaaggaggaguuggauaaauacuuuaaaaaucauacaucaccugauguagauuuaggugacauuucuggcauuaaugcuucaguugucaauauucaaaaggaaauugaccgccucaaugagguugccaaaaaucuaaaugaaucucucaucgaucuccaagaacuuggaaaguaugaacaguauauaaaauggccaugguacauuuggcuagguuuuauagcuggcuugauugccauaauaauggucacgauuaugcuuugcuguaugaccaguugcugcaguugucucaagggcuguuguucuugcggaucuugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12206 - RNA, 4094 nt, Artificial Sequence
  SARS-CoV-2/Wuhan/HBCDC-HB-01/2019__EPI_ISL_402132 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuaucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12207 - RNA, 4094 nt, Artificial Sequence
  SARS-CoV-2/Guangdong/20SF028/2020__EPI_ISL_403936 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuauauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12208 - RNA, 4094 nt, Artificial Sequence
  SARS-CoV-2/Shenzhen/SZTH-001/2020__EPI_ISL_406592 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguucuaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugggccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12209 - RNA, 4094 nt, Artificial Sequence
  SARS-CoV-2/Shenzhen/SZTH-004/2020__EPI_ISL_406595 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuugggacaggaagagaaucagcaacuguguugcuuauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcaggcauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12210 - RNA, 4094 nt, Artificial Sequence
  SARS-CoV-2/France/IDF0372/2020__EPI_ISL_406596 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuuuccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12211 - RNA, 4094 nt, Artificial Sequence
  SARS-CoV-2/Australia/VIC01/2020__EPI_ISL_406844 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaagguauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12212 - RNA, 4094 nt, Artificial Sequence
  SARS-CoV-2/Germany/BavPat1/2020__EPI_ISL_406862 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12213 - RNA, 4094 nt, Artificial Sequence
  SARS-CoV-2/Wuhan/HBCDC-HB-02/2020__EPI_ISL_412978 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaauuuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12214 - RNA, 4094 nt, Artificial Sequence
  SARS-CoV-2/Australia/QLD02/2020__EPI_ISL_407896 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaacuugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12215 - RNA, 4094 nt, Artificial Sequence
  SARS-CoV-2/India/1-31/2020__EPI_ISL_413523 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauaguguuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12216 - RNA, 4094 nt, Artificial Sequence
  SARS-CoV-2/Guangdong/GD2020087-P0008/2020__EPI_ISL_413863 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagagaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12217 - RNA, 4094 nt, Artificial Sequence
  SARS-CoV-2/Sweden/01/2020__EPI_ISL_411951 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuguggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12218 - RNA, 4094 nt, Artificial Sequence
  SARS-CoV-2/Tianmen/HBCDC-HB-07/2020__EPI_ISL_412983 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggaucuuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12219 - RNA, 4094 nt, Artificial Sequence
  SARS-CoV-2/Hong Kong/case42_VM20002493/2020__EPI_ISL_414527 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuugcuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12220 - RNA, 4094 nt, Artificial Sequence
  SARS-CoV-2/USA/CruiseA-23/2020__EPI_ISL_414482 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaguaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12221 - RNA, 4094 nt, Artificial Sequence
  SARS-CoV-2/Hong Kong/case85_VM20002868/2020__EPI_ISL_414519 spike protein mRNA wt (1-1273)
aggagagucccgcagucggcguccagcggcucugcuuguucgugugugugucguugcaggccuuauucaagcuuaccauguuuguuuuucuuguuuuagugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12222 - RNA, 4094 nt, Artificial Sequence
  SARS-CoV-2/England/200990660/2020__EPI_ISL_414523 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagcuagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12223 - RNA, 4094 nt, Artificial Sequence
  SARS-CoV-2/Australia/NSW09/2020__EPI_ISL_413595 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuucacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12224 - RNA, 4094 nt, Artificial Sequence
  SARS-CoV-2/Australia/NSW10/2020__EPI_ISL_413596 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcuucaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12225 - RNA, 4094 nt, Artificial Sequence
  SARS-CoV-2/Switzerland/1000477797/2020__EPI_ISL_413023 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaacauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12226 - RNA, 4094 nt, Artificial Sequence
  SARS-CoV-2/Belgium/BA-02291/2020__EPI_ISL_415159 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaggucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuaccugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuucugcagcaccugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12227 - RNA, 4094 nt, Artificial Sequence
  SARS-CoV-2/USA/WA8-UW5/2020__EPI_ISL_413486 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaauaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12228 - RNA, 4094 nt, Artificial Sequence
  SARS-CoV-2/England/20102000506/2020__EPI_ISL_415147 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauaugguuauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12229 - RNA, 4094 nt, Artificial Sequence
  SARS-CoV-2/Belgium/VAG-03013/2020__EPI_ISL_415155 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaacugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12230 - RNA, 4094 nt, Artificial Sequence
  SARS-CoV-2/Belgium/BC-03016/2020__EPI_ISL_415157 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaccugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12231 - RNA, 4094 nt, Artificial Sequence
  SARS-CoV-2/Germany/BavPat3/2020__EPI_ISL_414521 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaacaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12232 - RNA, 4094 nt, Artificial Sequence
  SARS-CoV-2/France/HF1805/2020__EPI_ISL_414628 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaguugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12233 - RNA, 4094 nt, Artificial Sequence
  SARS-CoV-2/Netherlands/ZuidHolland_9/2020__EPI_ISL_414445 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuuguguacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12234 - RNA, 4094 nt, Artificial Sequence
  SARS-CoV-2/Finland/FIN03032020A/2020__EPI_ISL_413602 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauaucuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12235 - RNA, 4094 nt, Artificial Sequence
  SARS-CoV-2/France/GE1977/2020__EPI_ISL_414632 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuuuuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12236 - RNA, 4094 nt, Artificial Sequence
  SARS-CoV-2/Finland/FIN-313/2020__EPI_ISL_414641 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuuaaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaaucuaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12237 - RNA, 4094 nt, Artificial Sequence
  SARS-CoV-2/Netherlands/ZuidHolland_2/2020__EPI_ISL_414556 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcucuugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12238 - RNA, 4094 nt, Artificial Sequence
  SARS-CoV-2/USA/WA-UW31/2020__EPI_ISL_414618 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaauggugcugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12239 - RNA, 4094 nt, Artificial Sequence
  SARS-CoV-2/South Korea/SNU01/2020__EPI_ISL_411929 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuugggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12240 - RNA, 4094 nt, Artificial Sequence
  SARS-CoV-2/China/WF0004/2020__EPI_ISL_413694 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggacggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagauuugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12241 - RNA, 4094 nt, Artificial Sequence
  SARS-CoV-2/China/WF0028/2020__EPI_ISL_413791 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagaaucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12242 - RNA, 4094 nt, Artificial Sequence
  SARS-CoV-2/2019-nCoV/USA-CruiseA-18/2020__MT159716.1 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguuaagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12243 - RNA, 4094 nt, Artificial Sequence
  SARS-CoV-2/SARS-CoV-2/Yunnan-01/human/2020/CHN__MT049951.1 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcaaacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12244 - RNA, 4094 nt, Artificial Sequence
  SARS-CoV-2/USA/WA-UW292/2020__EPI_ISL_418077 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccaguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12245 - RNA, 4094 nt, Artificial Sequence
  SARS-CoV-2/Iceland/192/2020__EPI_ISL_417819 spike protein mRNA wt (1-1273)
aggagagucccgcagucggcguccagcggcucugcuuguucgugugugugucguugcaggccuuauucaagcuuaccauguuuguuuuuuuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12246 - RNA, 4094 nt, Artificial Sequence
  SARS-CoV-2/Belgium/ULG-6939/2020__EPI_ISL_417020 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguuguuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12247 - RNA, 4094 nt, Artificial Sequence
  SARS-CoV-2/France/HF2496/2020__EPI_ISL_418231 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauuguugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12248 - RNA, 4094 nt, Artificial Sequence
  SARS-CoV-2/USA/WA-UW291/2020__EPI_ISL_418076 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaauacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12249 - RNA, 4094 nt, Artificial Sequence
  SARS-CoV-2/Portugal/PT0034/2020__EPI_ISL_418019 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguauuaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12250 - RNA, 4094 nt, Artificial Sequence
  SARS-CoV-2/Iceland/202/2020__EPI_ISL_417750 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucccuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12251 - RNA, 4094 nt, Artificial Sequence
  SARS-CoV-2/USA/WA-UW261/2020__EPI_ISL_418046 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuuacaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12252 - RNA, 4094 nt, Artificial Sequence
  SARS-CoV-2/Portugal/PT0035/2020__EPI_ISL_418020 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauuucugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12253 - RNA, 4094 nt, Artificial Sequence
  SARS-CoV-2/USA/NY-NYUMC7/2020__EPI_ISL_418192 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuaucaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12254 - RNA, 4094 nt, Artificial Sequence
  SARS-CoV-2/Iceland/189/2020__EPI_ISL_417709 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaccaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12255 - RNA, 4094 nt, Artificial Sequence
  SARS-CoV-2/Australia/NSW56/2020__EPI_ISL_417408 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauucaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12256 - RNA, 4094 nt, Artificial Sequence
  SARS-CoV-2/Iceland/280/2020__EPI_ISL_417608 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucauacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12257 - RNA, 4094 nt, Artificial Sequence
  SARS-CoV-2/Iceland/247/2020__EPI_ISL_417575 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauugugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12258 - RNA, 4094 nt, Artificial Sequence
  SARS-CoV-2/Iceland/238/2020__EPI_ISL_417566 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagauguuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12259 - RNA, 4094 nt, Artificial Sequence
  SARS-CoV-2/Greece/16/2020__EPI_ISL_418265 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauguugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12260 - RNA, 4094 nt, Artificial Sequence
  SARS-CoV-2/Iceland/319/2020__EPI_ISL_417648 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauagaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12261 - RNA, 4094 nt, Artificial Sequence
  SARS-CoV-2/Congo/94/2020__EPI_ISL_417947 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagauauacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12262 - RNA, 4094 nt, Artificial Sequence
  SARS-CoV-2/Congo/158/2020__EPI_ISL_417950 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuuuugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12263 - RNA, 4094 nt, Artificial Sequence
  SARS-CoV-2/USA/UT-00034/2020__EPI_ISL_417977 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuacuacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12264 - RNA, 4094 nt, Artificial Sequence
  SARS-CoV-2/USA/UT-00033/2020__EPI_ISL_417976 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuugacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12265 - RNA, 4094 nt, Artificial Sequence
  SARS-CoV-2/USA/WI-13/2020__EPI_ISL_417516 spike protein mRNA wt (1-1273)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccuaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12266 - RNA, 4091 nt, Artificial Sequence
  SARS-CoV-2/India/1-27/2020__EPI_ISL_413522 spike protein mRNA wt (1-1272)
aggagagucccgcagucggcguccagcggcucugcuuguucgugugugugucguugcaggccuuauucaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucauacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12267 - RNA, 4076 nt, Artificial Sequence
  SARS-CoV-2/pangolin/Guangxi/P4L/2017__EPI_ISL_410538 spike protein mRNA wt (1-1267)
aggagagucccgcagucggcguccagcggcucugcuuguucgugugugugucguugcaggccuuauucaagcuuaccauguuuguuuuucuuuuugucuugccuuugguuuccagucaaugugucaauuugaccacaagaacuggaauaccgccagguuauaccaauucaucuacuagaggugucuauuauccagacaaaguuuuuaggucuucaauuuuacaucuuacacaagaccuuuucuuaccuuucuuuucuaauguuacuugguuuaacaccauaaauuaucaaggaggcuuuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaaucuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugguaauuaugguuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauugcguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacccauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12268 - RNA, 4076 nt, Artificial Sequence
  SARS-CoV-2/pangolin/Guangxi/P5L/2017__EPI_ISL_410540 spike protein mRNA wt (1-1267)
aggagagucccgcagucggcguccagcggcucugcuuguucgugugugugucguugcaggccuuauucaagcuuaccauguuuguuuuucuuuuugucuugccuuugguuuccagucaaugugucaauuugaccacaagaacuggaauaccgccagguuauaccaauucaucuacuagaggugucuauuauccagacaaaguuuuuaggucuucaauuuuacaucuuacacaagaccuuuucuuaccuuucuuuucuaauguuacuugguuuaacaccauaaauuaucaaggaggcuuuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaagcuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugguaauuaugguuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauuucguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacucauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12269 - RNA, 4076 nt, Artificial Sequence
  SARS-CoV-2/pangolin/Guangxi/P5E/2017__EPI_ISL_410541 spike protein mRNA wt (1-1267)
aggagagucccgcagucggcguccagcggcucugcuuguucgugugugugucguugcaggccuuauucaagcuuaccauguuuguuuuucuuuuugucuugccuuugguuuccagucaaugugucaauuugaccacaagaacuggaauaccgccagguuauaccaauucaucuacuagaggugucuauuauccagacaaaguuuuuaggucuucaauuuuacaucuuacacaagaccuuuucuuaccuuucuuuucuaauguuacuugguuuaacaccauaacuuaucaaggaggcucuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaagcuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugauaauuaugguuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauuucguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacucauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12270 - RNA, 4070 nt, Artificial Sequence
  SARS-CoV-2/pangolin/Guangxi/P1E/2017__EPI_ISL_410539 spike protein mRNA wt (1-1265)
aggagagucccgcagucggcguccagcggcucugcuuguucgugugugugucguugcaggccuuauucaagcuuaccauguuuguuuuucuuuuugucuugccuuugguuuccagucaaugugucaauuugaccacaagaacuggaauacagccagguuauaccaauucaucuacuagaggugucuauuauccagacaaaguuuuuaggucuucaauuuuacaucuuacacaagaccuuuucuuaccuuucuuuucuaauguuacuugguuuaacaccauaaauuaucaaggaggcuuuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaagcuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugguaauuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauugcguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacucauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12271 - RNA, 4094 nt, Artificial Sequence; identical to SEQ ID NO: 148
  SARS-CoV-2/Wuhan/WIV05/2019__EPI_ISL_402128 spike protein mRNA gc (1-1273) R9488, R9492, R10161

SEQ ID NO: 12272 - RNA, 4082 nt, Artificial Sequence
  SARS-CoV-2/bat/Yunnan/RaTG13/2013__EPI_ISL_402131 spike protein mRNA gc (1-1269)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuccacccggggcgucuacuaccccgacaagguguuccgcagcuccgugcugcaccucacccaggaccuguuccugcccuucuucagcaacgucacgugguuccacgccauccacguguccgggaccaacggcaucaagcgguucgacaacccggugcuccccuucaacgacggggucuacuucgcgagcaccgagaaguccaacaucauccgcggcuggaucuucgggaccacgcuggacagcaagacccagucccugcucaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccugauggaccucgagggcaagcaggggaacuucaagaaccugcgcgaguucguguucaagaacaucgacggcuacuucaagaucuacuccaagcacacgccgaucaaccugguccgggaccucccgcccggguucagcgcccuggagccccugguggaccuccccaucggcaucaacaucacccgcuuccagacccugcuggcccuccaccgguccuaccugacccccggggacagcagcuccggcuggacggcgggcgccgccgccuacuacgugggguaccugcagccccgcaccuuccuccugaaguacaacgagaacggcaccaucaccgacgcggucgacugcgcccuggacccccucagcgagacgaagugcacccugaaguccuucaccguggagaaggggaucuaccagaccagcaacuuccgggugcagccgacggacuccaucguccgcuuccccaacaucaccaaccugugccccuucggcgagguguucaacgccaccaccuucgccagcgucuacgccuggaaccggaagcgcaucuccaacugcguggcggacuacagcgugcucuacaacuccacgagcuucuccaccuucaagugcuacggcgucagccccaccaagcugaacgaccugugcuucaccaacguguacgccgacuccuucgugaucacgggggacgagguccggcagaucgccccgggccagaccgggaagaucgccgacuacaacuacaagcuccccgacgacuucaccggcugcgugaucgccuggaacagcaagcacaucgacgcgaaggagggcgggaacuucaacuaccuguaccgccuguuccggaaggccaaccucaagcccuucgagcgcgacaucuccaccgagaucuaccaggccggcagcaagcccugcaacgggcagacgggccugaacugcuacuacccgcuguaccgguacggguucuaccccaccgacggcguggggcaccagcccuaccgcgucguggugcucuccuucgagcugcugaacgcccccgccaccgucugcggcccgaagaaguccaccaaccucgugaagaacaagugcgugaacuucaacuucaacggccugaccgggacgggcguccugaccgagagcaacaagaaguuccugcccuuccagcaguucgggcgggacaucgcggacaccaccgacgccgugcgcgacccccagacgcucgagauccuggacaucaccccgugcagcuucggcggggugagcgucaucacccccggcaccaacgccuccaaccagguggccgugcuguaccaggacgucaacugcacggaggugcccguggccauccacgcggaccagcucacccccaccuggcgcgucuacagcaccggcuccaacguguuccagacgcgggccgggugccugaucggcgccgagcacgugaacaacagcuacgagugcgacaucccgaucggggccggcaucugcgcguccuaccagacccagaccaacagccgcuccgucgccagccaguccaucaucgccuacaccaugagccugggcgccgagaacuccguggccuacagcaacaacuccaucgcgauccccacgaacuucaccaucagcgugaccaccgagauccuccccgucuccaugacgaagaccagcguggacugcaccauguacaucugcggggacuccaccgagugcagcaaccugcugcuccaguacggcagcuucugcacgcagcugaaccgggcccugaccgggaucgccguggagcaggacaagaacacccaggaggucuucgcccaggugaagcagaucuacaagacgcccccgaucaaggacuucggcggguucaacuucucccagauccuccccgaccccagcaagcccuccaagcgcagcuucaucgaggaccugcuguucaacaaggugacccucgccgacgcgggcuucaucaagcaguacggcgacugccugggggacaucgccgcccgggaccugaucugcgcccagaaguucaacggccucaccguccugccgccccugcucaccgacgagaugaucgcccaguacaccuccgcgcugcuggccgggacgaucaccagcggcuggaccuucggggccggcgccgcgcuccagauccccuucgccaugcagauggccuaccgcuucaacggcaucggggugacccagaacgugcuguacgagaaccagaagcugaucgccaaccaguucaacuccgccaucggcaagauccaggacagccucuccagcacggcguccgcccuggggaagcugcaggacgucgugaaccagaacgcccaggcccucaacacccuggugaagcagcugagcuccaacuucggcgccaucagcuccguccucaacgacauccugagccggcuggacaagguggaggcggaggugcagaucgaccgccucaucaccgggcggcugcagucccugcagaccuacgucacccagcagcucauccgcgccgccgagauccgggccagcgccaaccuggcggccacgaagauguccgagugcgugcugggccagagcaagcgcguggacuucugcggcaagggguaccaccucaugagcuucccccaguccgccccgcacggcgucguguuccugcacgugaccuacguccccgcccaggagaagaacuucaccaccgcgcccgccaucugccacgacgggaaggcccacuucccccgggagggcguguucgucagcaacgggacgcacugguucgugacccagcgcaacuucuacgagccgcagaucaucaccaccgacaacacguucguguccggcagcugcgacgucgugaucggcaucgugaacaacaccgucuacgacccccugcagcccgagcucgacuccuucaaggaggagcuggacaaguacuucaagaaccacaccagccccgacguggaccugggggacaucuccggcaucaacgccagcguggucaacauccagaaggagaucgaccggcucaacgagguggccaagaaccugaacgagucccugaucgaccuccaggagcuggggaaguacgagcaguacaucaaguggccgugguacaucuggcugggcuucaucgcgggccucaucgccaucaucauggugaccaucaugcugugcugcaugacgagcugcugcuccugccugaaggggugcugcagcugcggcuccugcugcaaguucgacgaggacgacagcgagcccguccucaagggggugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12273 - RNA, 4094 nt, Artificial Sequence
  SARS-CoV-2/Wuhan/HBCDC-HB-01/2019__EPI_ISL_402132 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcaucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12274 - RNA, 4094 nt, Artificial Sequence
  SARS-CoV-2/Guangdong/20SF028/2020__EPI_ISL_403936 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcuguacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12275 - RNA, 4094 nt, Artificial Sequence
  SARS-CoV-2/Shenzhen/SZTH-001/2020__EPI_ISL_406592 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacgugcugaucggcaucgucaacaacacgguguacgacccccugcagcccgagcucgacuccuucaaggaggagcuggacaaguacuucaagaaccacaccagccccgacguggaccugggggacaucuccggcaucaacgccagcgucgugaacauccagaaggagaucgaccgccucaacgagguggccaagaaccugaacgagucccugaucgaccuccaggagcuggggaaguacgagcaguacaucaaguggccgugguacaucuggcugggcuucaucgccggccucaucgcgaucgucauggugaccaucaugcugugcugcaugaccagcugcugcuccugccugaaggggugcugcagcugcggcuccugcugcaaguucgacgaggacgacagcgggcccgugcucaagggcgucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12276 - RNA, 4094 nt, Artificial Sequence
  SARS-CoV-2/Shenzhen/SZTH-004/2020__EPI_ISL_406595 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccugggaccgcaagcggaucuccaacugcguggcguacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12277 - RNA, 4094 nt, Artificial Sequence
  SARS-CoV-2/France/IDF0372/2020__EPI_ISL_406596 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccaggacgugaacugcaccgaggugcccgucgccauccacgccgaccagcugacgcccaccuggcggguguacuccaccggcagcaacguguuccagacccgcgccgggugccucaucggcgcggagcacgucaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcguggccuacuccaacaacagcaucgccauccccaccaacuucacgaucuccgucaccaccgagauccugcccgugagcaugaccaagacgagcguggacugcaccauguacaucugcggggacuccaccgagugcagcaaccuccugcugcaguacggcuccuucugcacccagcucaaccgcgcgcugacggggaucgccgucgagcaggacaagaacacccaggagguguucgcccaggugaagcagaucuacaagacgcccccgaucaaggacuucggcggguucaacuucagccagauccugcccgaccccuccaagcccagcaagcgguccuucaucgaggaccuccuguucaacaaggucacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggugacccagaacguccucuacgagaaccagaagcugaucgccaaccaguucaacagcgccaucggcaagauccaggacucccugagcuccaccgccagcgcgcucgggaagcugcaggacguggugaaccagaacgcccaggcccugaacacgcucgucaagcagcuguccagcaacuucggcgccaucuccagcgugcugaacgacauccucucccgccuggacaagguggaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgccccgcacggcgugguguuccuccacgucacguacgugcccgcccaggagaagaacuucaccaccgcccccgcgaucugccacgacgggaaggcccacuucccccgcgagggcgucuucguguccaacgggacccacugguucgugacgcagcggaacuucuacgagccgcagaucaucaccaccgacaacaccuucgucagcggcaacugcgacguggugaucggcaucgucaacaacacgguguacgacccccugcagcccgagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagcccgugcugaagggggucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12278 - RNA, 4094 nt, Artificial Sequence
  SARS-CoV-2/Australia/VIC01/2020__EPI_ISL_406844 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccggcgcuaccucacgccgggggacuccagcagcggcuggaccgcgggcgccgccgccuacuacgugggguaccugcagccccggaccuuccugcucaaguacaacgagaacggcaccaucacggacgcggucgacugcgcccuggacccccuguccgagaccaagugcacccucaagagcuucaccguggagaaggggaucuaccagacguccaacuuccgcgugcagcccaccgagagcaucguccgguucccgaacaucaccaaccugugccccuucggcgagguguucaacgccacccgcuucgccuccgucuacgccuggaaccggaagcgcaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccggcuguuccgcaaguccaaccucaagcccuucgagcgggacaucagcaccgagaucuaccaggccggcuccacccccugcaacgggguggagggcuucaacugcuacuucccccugcagagcuacggguuccagccgaccaacggcgugggguaccagcccuaccgcguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgggacccccagacccuggagauccucgacaucacccccugcagcuucggcggggugagcgugaucacgccgggcaccaacaccuccaaccaggucgccgugcuguaccaggacgugaacugcaccgagguccccguggccauccacgccgaccagcugacgcccaccuggcgcguguacagcaccggcuccaacgucuuccagacccgggccgggugccucaucggcgcggagcacgugaacaacagcuacgagugcgacauccccaucggggccggcaucugcgccuccuaccagacgcagaccaacagcccgcgccgggcccgcuccguggcgagccaguccaucaucgccuacaccaugagccugggcgccgagaacuccgucgccuacagcaacaacuccaucgccauccccaccaacuucacgaucagcgugaccaccgagauccugcccguguccaugaccaagacgagcgucgacugcaccauguacaucugcggggacagcaccgagugcuccaaccuccugcugcaguacggcagcuucugcacccagcucaaccgggcgcugacggggaucgccguggagcaggacaagaacacccaggagguguucgcccaggucaagcagaucuacaagacgcccccgaucaaggacuucggcggguucaacuucucccagauccugcccgaccccagcaagcccuccaagcgcagcuucaucgaggaccuccuguucaacaaggugacccuggccgacgccggcuucaucaagcaguacggcgacugccucggggacaucgcggcccgggaccugaucugcgcccagaaguucaacggccugaccgugcucccgccccugcugaccgacgagaugaucgcccaguacaccuccgcccuccuggcggggaccaucacgagcggcuggaccuucggggccggcgccgcccugcagauccccuucgcgaugcagauggccuaccgcuucaacggcaucggggucacccagaacgugcucuacgagaaccagaagcugaucgccaaccaguucaacuccgccaucggcaagauccaggacagccuguccagcaccgccuccgcgcucgggaagcugcaggacguggucaaccagaacgcccaggcccugaacacgcucgugaagcagcugagcuccaacuucggcgccaucagcuccgugcugaacgacauccucagccggcuggacaaggucgaggccgaggugcagaucgaccgccugaucaccgggcggcuccagucccugcagaccuacgugacccagcagcugauccgcgcggccgagauccgggccagcgccaaccucgccgcgaccaagaugagcgagugcguccugggccaguccaagcgcguggacuucugcggcaagggguaccaccugaugagcuucccccaguccgccccgcacggcguggucuuccuccacgugacguacguccccgcccaggagaagaacuucaccaccgcccccgcgaucugccacgacgggaaggcccacuucccccgggagggcguguucgugagcaacgggacccacugguucgucacgcagcgcaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccggcugaacgaggucgccaagaaccucaacgagagccugaucgaccugcaggagcucgggaaguacgagcaguacaucaaguggccgugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12279 - RNA, 4094 nt, Artificial Sequence
  SARS-CoV-2/Germany/BavPat1/2020__EPI_ISL_406862 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12280 - RNA, 4094 nt, Artificial Sequence
  SARS-CoV-2/Wuhan/HBCDC-HB-02/2020__EPI_ISL_412978 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaacuuccuccugcaguacggcuccuucugcacccagcugaaccgcgcgcucacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccgugcugccgccccuccugaccgacgagaugaucgcccaguacaccagcgcccugcucgcggggaccaucacguccggcuggaccuucggggccggcgccgcccugcagauccccuucgcgaugcagauggccuaccgguucaacggcaucggggucacccagaacgugcuguacgagaaccagaagcucaucgccaaccaguucaacagcgccaucggcaagauccaggacucccugagcuccaccgccagcgcgcuggggaagcuccaggacguggucaaccagaacgcccaggcccugaacacgcuggugaagcagcucuccagcaacuucggcgccaucuccagcgugcugaacgacauccugucccgccucgacaaggucgaggccgaggugcagaucgaccggcugaucaccgggcgccugcagagccuccagaccuacgugacccagcagcugauccgggcggccgagauccgcgccagcgccaaccuggccgcgaccaagauguccgagugcguccucggccagagcaagcggguggacuucugcggcaagggguaccaccugauguccuucccccagagcgccccgcacggcguggucuuccugcacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccuccagcccgagcuggacuccuucaaggaggagcuggacaaguacuucaagaaccacaccagccccgacgucgaccucggggacaucuccggcaucaacgccagcguggugaacauccagaaggagaucgaccgccugaacgaggucgccaagaaccugaacgagucccucaucgaccugcaggagcuggggaaguacgagcaguacaucaaguggccgugguacaucuggcucggcuucaucgccggccugaucgcgaucgugauggugaccaucaugcugugcugcaugaccagcugcugcuccugccucaaggggugcugcagcugcggcuccugcugcaaguucgacgaggacgacagcgagcccguccugaagggggugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12281 - RNA, 4094 nt, Artificial Sequence
  SARS-CoV-2/Australia/QLD02/2020__EPI_ISL_407896 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcuggagcucgacuccuucaaggaggagcuggacaaguacuucaagaaccacaccagccccgacgucgaccugggggacaucuccggcaucaacgccagcguggugaacauccagaaggagaucgaccgccucaacgaggucgccaagaaccugaacgagucccugaucgaccuccaggagcuggggaaguacgagcaguacaucaaguggcccugguacaucuggcugggcuucaucgccggccucaucgcgaucgugauggugaccaucaugcugugcugcaugaccagcugcugcuccugccugaaggggugcugcagcugcggcuccugcugcaaguucgacgaggacgacagcgagccgguccucaagggggugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12282 - RNA, 4094 nt, Artificial Sequence
  SARS-CoV-2/India/1-31/2020__EPI_ISL_413523 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgugaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccgccuggacaagguggaggccgaggugcagaucgaccggcugaucaccgggcgccuccagagccugcagaccuacgucacccagcagcugauccgggccgcggagauccgcgccagcgccaaccucgccgccaccaagauguccgagugcgugcugggccagagcaagcggguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgcgagggcguguucgucuccaacgggacccacugguucgugacgcagcggaacuucuacgagccgcagaucaucaccaccgacaacaccuucgugagcggcaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12283 - RNA, 4094 nt, Artificial Sequence
  SARS-CoV-2/Guangdong/GD2020087-P0008/2020__EPI_ISL_413863 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccgggagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12284 - RNA, 4094 nt, Artificial Sequence
  SARS-CoV-2/Sweden/01/2020__EPI_ISL_411951 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacugcggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12285 - RNA, 4094 nt, Artificial Sequence
  SARS-CoV-2/Tianmen/HBCDC-HB-07/2020__EPI_ISL_412983 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggaccugaacugcaccgaggugcccgucgccauccacgccgaccagcucacgcccaccuggcggguguacuccaccggcagcaacguguuccagacccgcgccgggugccugaucggcgcggagcacgucaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcguggccuacuccaacaacagcaucgccauccccaccaacuucacgaucuccgucaccaccgagauccuccccgugagcaugaccaagacgagcguggacugcaccauguacaucugcggggacuccaccgagugcagcaaccugcugcuccaguacggcuccuucugcacccagcugaaccgcgcgcugacggggaucgccgucgagcaggacaagaacacccaggagguguucgcccaggugaagcagaucuacaagacgcccccgaucaaggacuucggcggguucaacuucagccagauccuccccgaccccuccaagcccagcaagcgguccuucaucgaggaccugcuguucaacaaggucacccucgccgacgccggcuucaucaagcaguacggcgacugccugggggacaucgcggcccgcgaccugaucugcgcccagaaguucaacggccucaccgugcugccgccccugcucaccgacgagaugaucgcccaguacaccagcgcccugcuggcggggaccaucacguccggcuggaccuucggggccggcgccgcccuccagauccccuucgcgaugcagauggccuaccgguucaacggcaucggggugacccagaacguccuguacgagaaccagaagcugaucgccaaccaguucaacagcgccaucggcaagauccaggacucccucagcuccaccgccagcgcgcuggggaagcugcaggacguggugaaccagaacgcccaggcccucaacacgcuggucaagcagcuguccagcaacuucggcgccaucuccagcgugcucaacgacauccugucccgccuggacaagguggaggccgagguccagaucgaccggcucaucaccgggcgccugcagagccugcagaccuacgugacccagcagcucauccgggcggccgagauccgcgccagcgccaaccuggccgcgaccaagauguccgagugcgugcugggccagagcaagcgggucgacuucugcggcaagggguaccaccucauguccuucccccagagcgccccgcacggcgugguguuccugcacgucacguacgugcccgcccaggagaagaacuucaccaccgcccccgcgaucugccacgacgggaaggcccacuucccccgcgagggcgucuucguguccaacgggacccacugguucgugacgcagcggaacuucuacgagccgcagaucaucaccaccgacaacaccuucgucagcggcaacugcgacguggugaucggcaucgucaacaacacgguguacgacccccugcagcccgagcucgacuccuucaaggaggagcuggacaaguacuucaagaaccacaccagccccgacguggaccugggggacaucuccggcaucaacgccagcgucgugaacauccagaaggagaucgaccgccucaacgagguggccaagaaccugaacgagucccugaucgaccuccaggagcuggggaaguacgagcaguacaucaaguggccgugguacaucuggcugggcuucaucgccggccucaucgcgaucgucauggugaccaucaugcugugcugcaugaccagcugcugcuccugccugaaggggugcugcagcugcggcuccugcugcaaguucgacgaggacgacagcgagcccgugcucaagggggucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12286 - RNA, 4094 nt, Artificial Sequence
  SARS-CoV-2/Hong Kong/case42_VM20002493/2020__EPI_ISL_414527 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucgcgaucuccgugacgaccgagauccugcccgugagcaugaccaagaccagcgucgacugcacgauguacaucugcggggacuccaccgagugcagcaaccuccugcugcaguacggcuccuucugcacccagcucaaccgcgcccugaccgggaucgccguggagcaggacaagaacacgcaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccagcgcgcuccuggccgggaccaucaccuccggcuggacguucggggccggcgccgcgcugcagauccccuucgccaugcagauggccuaccgguucaacggcaucggggucacccagaacgugcucuacgagaaccagaagcugaucgccaaccaguucaacagcgccaucggcaagauccaggacucccugagcuccaccgcgagcgcccucgggaagcugcaggacguggucaaccagaacgcccaggcccugaacacccucgugaagcagcuguccagcaacuucggcgccaucuccagcgugcugaacgacauccucucccgccuggacaaggucgaggcggaggugcagaucgaccggcugaucacggggcgccuccagagccugcagaccuacgugacccagcagcugauccgggccgccgagauccgcgccagcgccaaccucgcggccaccaagauguccgagugcguccugggccagagcaagcggguggacuucugcggcaagggguaccaccugauguccuucccccagagcgccccgcacggcguggucuuccuccacgugaccuacguccccgcccaggagaagaacuucacgaccgcgcccgccaucugccacgacgggaaggcccacuucccccgcgagggcguguucguguccaacgggacccacugguucgucacccagcggaacuucuacgagccgcagaucaucacgaccgacaacaccuucgugagcggcaacugcgacguggucaucggcaucgugaacaacaccguguacgacccccugcagcccgagcuggacuccuucaaggaggagcucgacaaguacuucaagaaccacacgagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgcgggccugaucgccaucgugauggugaccaucaugcucugcugcaugaccagcugcugcuccugccugaaggggugcugcagcugcggcuccugcugcaaguucgacgaggacgacagcgagcccguccugaagggggugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12287 - RNA, 4094 nt, Artificial Sequence
  SARS-CoV-2/USA/CruiseA-23/2020__EPI_ISL_414482 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggaggugaagcagggcaacuucaagaaccuccgcgaguucgucuucaagaacaucgacggguacuucaagaucuacuccaagcacaccccgaucaaccuggugcgggaccugccccagggcuucagcgcccucgagccccugguggaccugcccaucgggaucaacaucacccgcuuccagacccuccuggcccugcaccgguccuaccucacgccgggcgacagcagcuccggguggaccgcgggcgccgccgccuacuacgucggcuaccugcagccccgcaccuuccugcucaaguacaacgagaacgggaccaucacggacgcgguggacugcgcccuggacccccugagcgagaccaagugcacccucaaguccuucaccguggagaagggcaucuaccagacgagcaacuuccggguccagcccaccgaguccaucgugcgcuucccgaacaucaccaaccugugccccuucggggaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggcgacgaggugcggcagaucgcccccgggcagaccggcaagaucgccgacuacaacuacaagcugccggacgacuucacggggugcgugaucgcguggaacagcaacaaccucgacuccaaggucggcgggaacuacaacuaccuguaccgccuguuccgcaagagcaaccucaagcccuucgagcgggacaucuccaccgagaucuaccaggccggcagcacccccugcaacggcguggagggguucaacugcuacuucccccugcaguccuacggcuuccagccgaccaacggggugggcuaccagcccuaccgggucguggugcugagcuucgagcuccugcacgcccccgccacggucugcgggcccaagaaguccaccaaccuggugaagaacaagugcgugaacuucaacuucaacggccucaccggcaccgggguccugaccgagagcaacaagaaguuccugccguuccagcaguucggccgcgacaucgccgacacgaccgacgcggugcgcgacccccagacccuggagauccucgacaucacccccugcagcuucgggggcguguccgucaucacgccggggaccaacaccagcaaccagguggccgugcuguaccaggacgucaacugcaccgaggugcccguggccauccacgccgaccagcugacgcccaccuggcgggucuacuccaccggcagcaacguguuccagacccgcgccggcugccucaucggggcggagcacgugaacaacuccuacgagugcgacauccccaucggcgccgggaucugcgccagcuaccagacgcagaccaacuccccgcggcgcgcccggagcgucgcgucccagagcaucaucgccuacaccaugucccugggcgccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggguucaucaagcaguacggcgacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggggccgcccugcagauccccuucgcgaugcagauggccuaccgguucaacggcaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcuggggcagagcaagcggguggacuucugcggcaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggguucaucgccggccugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12288 - RNA, 4094 nt, Artificial Sequence
  SARS-CoV-2/Hong Kong/case85_VM20002868/2020__EPI_ISL_414519 spike protein mRNA gc (1-1273)
aggagagucccgcagucggcguccagcggcucugcuuguucgugugugugucguugcaggccuuauucaagcuuaccauguucguguuccugguccucgugccccuggugagcucccagugcgucaaccugaccacccgcacgcagcucccgcccgccuacaccaacagcuucacccggggcguguacuaccccgacaagguguuccgcuccagcguccugcacuccacccaggaccuguuccuccccuucuucagcaacgugacgugguuccacgccauccacguguccgggaccaacggcaccaagcgguucgacaacccgguccugcccuucaacgacgggguguacuucgcgagcaccgagaaguccaacaucauccgcggcuggaucuucgggacgacccuggacagcaagacccagucccuccugaucgugaacaacgccaccaacgucgugaucaaggugugcgaguuccaguucugcaacgaccccuuccugggcgucuacuaccacaagaacaacaagagcuggauggaguccgaguuccggguguacagcuccgccaacaacugcacguucgaguacgugagccagcccuuccucauggaccuggagggcaagcaggggaacuucaagaaccugcgcgaguucgucuucaagaacaucgacggcuacuucaagaucuacuccaagcacaccccgaucaaccucgugcgggaccugccccagggguucagcgcccuggagccccucguggaccugcccaucggcaucaacaucacccgcuuccagacccugcucgcccugcaccgguccuaccugacgccgggggacagcagcuccggcuggaccgcgggcgccgccgccuacuacgucggguaccuccagccccgcaccuuccugcugaaguacaacgagaacggcaccaucacggacgcgguggacugcgcccucgacccccugagcgagaccaagugcacccugaaguccuucaccguggagaaggggaucuaccagacgagcaacuuccggguccagcccaccgaguccaucgugcgcuucccgaacaucaccaaccucugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcugaacgaccucugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccuggacuccaaggucgggggcaacuacaacuaccucuaccgccuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccgggucguggugcugagcuucgagcugcuccacgcccccgccacggucugcggccccaagaaguccaccaaccuggugaagaacaagugcgugaacuucaacuucaacggccugaccgggaccggcguccucaccgagagcaacaagaaguuccugccguuccagcaguucgggcgcgacaucgccgacacgaccgacgcggugcgcgacccccagacccuggagauccuggacaucacccccugcagcuucggcgggguguccgucaucacgccgggcaccaacaccagcaaccagguggccgugcucuaccaggacgucaacugcaccgaggugcccguggccauccacgccgaccagcugacgcccaccuggcgggucuacuccaccggcagcaacguguuccagacccgcgccgggugccugaucggcgcggagcacgugaacaacuccuacgagugcgacauccccaucggggccggcaucugcgccagcuaccagacgcagaccaacuccccgcggcgcgcccggagcgucgcgucccagagcaucaucgccuacaccaugucccucggcgccgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccugcuccugcaguacggcuccuucugcacccagcugaaccgcgcgcucacggggaucgccguggagcaggacaagaacacccaggaggucuucgcccaggugaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccguccugccgccccuccugaccgacgagaugaucgcccaguacaccagcgcccugcucgcggggaccaucacguccggcuggaccuucggggccggcgccgcccugcagauccccuucgcgaugcagauggccuaccgguucaacggcaucggggugacccagaacgugcuguacgagaaccagaagcucaucgccaaccaguucaacagcgccaucggcaagauccaggacucccugagcuccaccgccagcgcgcuggggaagcuccaggacgucgugaaccagaacgcccaggcccugaacacgcuggugaagcagcucuccagcaacuucggcgccaucuccagcguccugaacgacauccugucccgccucgacaagguggaggccgaggugcagaucgaccggcugaucaccgggcgccugcagagccuccagaccuacgucacccagcagcugauccgggcggccgagauccgcgccagcgccaaccuggccgcgaccaagauguccgagugcgugcucggccagagcaagcggguggacuucugcggcaagggguaccaccugauguccuucccccagagcgccccgcacggcgucguguuccugcacgucacguacgugcccgcccaggagaagaacuucaccaccgcccccgcgaucugccacgacgggaaggcccacuucccccgcgagggcguguucgucuccaacgggacccacugguucgugacgcagcggaacuucuacgagccgcagaucaucaccaccgacaacaccuucgugagcggcaacugcgacgucgugaucggcaucgugaacaacacggucuacgacccccuccagcccgagcuggacuccuucaaggaggagcuggacaaguacuucaagaaccacaccagccccgacguggaccucggggacaucuccggcaucaacgccagcguggucaacauccagaaggagaucgaccgccugaacgagguggccaagaaccugaacgagucccucaucgaccugcaggagcuggggaaguacgagcaguacaucaaguggccgugguacaucuggcucggcuucaucgccggccugaucgcgaucgugauggucaccaucaugcugugcugcaugaccagcugcugcuccugccucaaggggugcugcagcugcggcuccugcugcaaguucgacgaggacgacagcgagcccgugcugaagggggugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12289 - RNA, 4094 nt, Artificial Sequence
  SARS-CoV-2/England/200990660/2020__EPI_ISL_414523 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcugguccucaagggcgugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12290 - RNA, 4094 nt, Artificial Sequence
  SARS-CoV-2/Australia/NSW09/2020__EPI_ISL_413595 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuucaccgccuccgcgcucgggaagcugcaggacguggucaaccagaacgcccaggcccugaacacgcucgugaagcagcugagcuccaacuucggcgccaucagcuccgugcugaacgacauccucagccgccuggacaaggucgaggccgaggugcagaucgaccggcugaucaccgggcgccuccagucccugcagaccuacgugacccagcagcugauccgggcggccgagauccgcgccagcgccaaccucgccgcgaccaagaugagcgagugcguccugggccaguccaagcggguggacuucugcggcaagggguaccaccugaugagcuucccccaguccgccccgcacggcguggucuuccuccacgugacguacguccccgcccaggagaagaacuucaccaccgcccccgcgaucugccacgacgggaaggcccacuucccccgcgagggcguguucgugagcaacgggacccacugguucgucacgcagcggaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggccgugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12291 - RNA, 4094 nt, Artificial Sequence
  SARS-CoV-2/Australia/NSW10/2020__EPI_ISL_413596 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcuucaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12292 - RNA, 4094 nt, Artificial Sequence
  SARS-CoV-2/Switzerland/1000477797/2020__EPI_ISL_413023 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaacaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12293 - RNA, 4094 nt, Artificial Sequence
  SARS-CoV-2/Belgium/BA-02291/2020__EPI_ISL_415159 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccggcgcagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccgcguggucgugcugagcuucgagcuccugcccgcccccgccacggugugcggcccgaagaaguccaccaaccuggucaagaacaagugcgugaacuucaacuucaacggccucaccgggaccggcgugcugaccgaguccaacaagaaguuccugcccuuccagcaguucgggcgcgacaucgccgacacgaccgacgcgguccgggacccccagacccuggagauccucgacaucaccccgugcagcuucggcgggguguccgugaucacgcccggcaccaacaccagcaaccaggucgccgugcuguaccagggcgugaacugcaccgagguccccguggccauccacgccgaccagcugacgcccaccuggcgcguguacuccaccgggagcaacgucuuccagacccgggccggcugccucaucggggcggagcacgugaacaacuccuacgagugcgacaucccgaucggcgccggcaucugcgccagcuaccagacgcagaccaacagcccccgccgggcccgcagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcgcugacgggcaucgccguggagcaggacaagaacacccaggagguguucgcccaggucaagcagaucuacaagaccccgcccaucaaggacuucgggggcuucaacuucagccagauccugcccgaccccuccaagccgagcaagcgcuccuucaucgaggaccuccuguucaacaaggugacccuggccgacgccggcuucaucaagcaguacggggacugccucggcgacaucgcggcccgggaccugaucugcgcccagaaguucaacgggcugacggugcucccgccccugcugaccgacgagaugaucgcccaguacaccagcgcccuccuggcgggcaccaucacguccggguggaccuucggcgccggcgccgcccugcagauccccuucgcgaugcagauggccuaccgcuucaacgggaucggcgucacccagaacgugcucuacgagaaccagaagcugaucgccaaccaguucaacagcgccaucgggaagauccaggacucccugagcuccgccgcgcccgcccucggcaagcugcaggacguggucaaccagaacgcccaggcccugaacacccucgugaagcagcugagcuccaacuucggggccaucagcuccgugcugaacgacauccucagccggcuggacaaggucgaggcggaggugcagaucgaccgccugaucacgggccggcuccagucccugcagaccuacgugacccagcagcugauccgcgccgccgagauccgggccagcgccaaccucgcggccaccaagaugagcgagugcguccugggccaguccaagcgcguggacuucugcgggaagggcuaccaccugaugagcuucccccaguccgcgccccacgggguggucuuccuccacgugaccuacguccccgcccaggagaagaacuucacgaccgccccggccaucugccacgacggcaaggcccacuucccccgggaggggguguucgugagcaacggcacccacugguucgucacccagcgcaacuucuacgagccccagaucaucacgaccgacaacaccuucguguccggcaacugcgacguggucaucgggaucgugaacaacaccguguacgacccccugcagccggagcuggacagcuucaaggaggagcucgacaaguacuucaagaaccacacgucccccgacgucgaccugggcgacaucagcgggaucaacgccuccguggugaacauccagaaggagaucgaccggcugaacgaggucgccaagaaccucaacgagagccugaucgaccugcaggagcucggcaaguacgagcaguacaucaaguggcccugguacaucuggcugggcuucaucgcggggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12294 - RNA, 4094 nt, Artificial Sequence
  SARS-CoV-2/USA/WA8-UW5/2020__EPI_ISL_413486 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12295 - RNA, 4094 nt, Artificial Sequence
  SARS-CoV-2/England/20102000506/2020__EPI_ISL_415147 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggguacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12296 - RNA, 4094 nt, Artificial Sequence
  SARS-CoV-2/Belgium/VAG-03013/2020__EPI_ISL_415155 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccacggcgcucggcaagcugcaggacguggucaaccagaacgcccaggcccugaacacccucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgacgaagaugagcgagugcguccugggccaguccaagcggguggacuucugcgggaagggcuaccaccugaugagcuucccccaguccgccccgcacgggguggucuuccuccacgugaccuacguccccgcccaggagaagaacuucaccaccgcccccgcgaucugccacgacggcaaggcccacuucccccgcgaggggguguucgugagcaacggcacgcacugguucgucacccagcggaacuucuacgagccgcagaucaucaccaccgacaacacguucguguccggcaacugcgacguggucaucgggaucgugaacaacaccguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugacguccugcugcagcugccugaagggcugcugcuccugcgggagcugcugcaaguucgacgaggacgacuccgagcccguccugaagggcgugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12297 - RNA, 4094 nt, Artificial Sequence
  SARS-CoV-2/Belgium/BC-03016/2020__EPI_ISL_415157 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgcccccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccgcaguccgcgccccacgggguggucuuccuccacgugacguacguccccgcccaggagaagaacuucaccaccgcccccgccaucugccacgacggcaaggcccacuucccgcgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccuccccggacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12298 - RNA, 4094 nt, Artificial Sequence
  SARS-CoV-2/Germany/BavPat3/2020__EPI_ISL_414521 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccagcaggucuucgcccaggugaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12299 - RNA, 4094 nt, Artificial Sequence
  SARS-CoV-2/France/HF1805/2020__EPI_ISL_414628 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggguggugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12300 - RNA, 4094 nt, Artificial Sequence
  SARS-CoV-2/Netherlands/ZuidHolland_9/2020__EPI_ISL_414445 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgugcagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12301 - RNA, 4094 nt, Artificial Sequence
  SARS-CoV-2/Finland/FIN03032020A/2020__EPI_ISL_413602 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucagcuggaacuccaacaaccucgacagcaaggucgggggcaacuacaacuaccuguaccgccuguuccggaaguccaaccucaagcccuucgagcgcgacaucagcaccgagaucuaccaggcgggcuccacccccugcaacgggguggagggcuucaacugcuacuucccccugcagagcuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcuccuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccaucaucgcguacaccaugagccugggggccgagaacuccgucgccuacagcaacaacuccaucgccauccccaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgcgcccugacgggcaucgcgguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccgugcucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgucacccagaacgugcucuacgagaaccagaagcugaucgccaaccaguucaacuccgccaucgggaagauccaggacagccuguccagcaccgccuccgcccucggcaagcugcaggacguggucaaccagaacgcgcaggcccugaacacgcucgugaagcagcugagcuccaacuucggggccaucagcuccgugcugaacgacauccucagccgccuggacaaggucgaggccgaggugcagaucgaccggcugaucaccggccgccuccagagccugcagaccuacgugacccagcagcugauccgggccgcggagauccgcgccuccgccaaccucgccgccaccaagaugagcgagugcguccugggccaguccaagcggguggacuucugcgggaagggcuaccaccugaugagcuucccccaguccgcgccgcacgggguggucuuccuccacgugacguacguccccgcccaggagaagaacuucaccaccgcccccgccaucugccacgacggcaaggcgcacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12302 - RNA, 4094 nt, Artificial Sequence
  SARS-CoV-2/France/GE1977/2020__EPI_ISL_414632 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccuguucagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12303 - RNA, 4094 nt, Artificial Sequence
  SARS-CoV-2/Finland/FIN-313/2020__EPI_ISL_414641 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuucaagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12304 - RNA, 4094 nt, Artificial Sequence
  SARS-CoV-2/Netherlands/ZuidHolland_2/2020__EPI_ISL_414556 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgcccuggagcaggacaagaacacccaggagguguucgcccaggugaagcagaucuacaagacgcccccgaucaaggacuucgggggcuucaacuucagccagauccuccccgaccccuccaagcccagcaagcgguccuucaucgaggaccugcuguucaacaaggucacccucgccgacgccggcuucaucaagcaguacggggacugccugggcgacaucgcggcccgcgaccugaucugcgcccagaaguucaacgggcucaccgugcugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgugacccagaacguccuguacgagaaccagaagcugaucgccaaccaguucaacagcgccaucgggaagauccaggacucccucagcuccaccgccagcgcgcugggcaagcugcaggacguggugaaccagaacgcccaggcccucaacacgcuggucaagcagcuguccagcaacuucggggccaucuccagcgugcucaacgacauccugucccgccuggacaagguggaggccgagguccagaucgaccggcucaucaccggccgccugcagagccugcagaccuacgugacccagcagcucauccgggcggccgagauccgcgccagcgccaaccuggccgcgaccaagauguccgagugcgugcugggccagagcaagcgggucgacuucugcgggaagggcuaccaccucauguccuucccccagagcgccccgcacggggugguguuccugcacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcucgacuccuucaaggaggagcuggacaaguacuucaagaaccacaccagccccgacguggaccugggcgacaucuccgggaucaacgccagcgucgugaacauccagaaggagaucgaccgccucaacgagguggccaagaaccugaacgagucccugaucgaccuccaggagcugggcaaguacgagcaguacaucaaguggccgugguacaucuggcugggcuucaucgccgggcucaucgcgaucgucauggugaccaucaugcugugcugcaugaccagcugcugcuccugccugaagggcugcugcagcugcggguccugcugcaaguucgacgaggacgacagcgagcccgugcucaagggcgucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12305 - RNA, 4094 nt, Artificial Sequence
  SARS-CoV-2/USA/WA-UW31/2020__EPI_ISL_414618 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgcggacacgaccgacgccgugcgcgacccccagacccuggagauccucgacaucacccccugcagcuucggcggggucuccgugaucacgccgggcaccaacaccagcaaccagguggccguccuguaccaggacgugaacugcaccgaggugcccgucgccauccacgccgaccagcugacgcccaccuggcggguguacuccaccggcagcaacguguuccagacccgcgcggggugccucaucggcgccgagcacgucaacaacuccuacgagugcgacauccccaucggggccggcaucugcgccagcuaccagacgcagaccaacuccccgcggcgcgcgcggagcguggccucccagagcaucaucgccuacaccaugucccugggcgccgagaacagcguggccuacuccaacaacagcaucgcgauccccaccaacuucacgaucuccgucaccaccgagauccugcccgugagcaugaccaagacgagcguggacugcaccauguacaucugcggggacuccaccgagugcagcaaccuccugcugcaguacggcuccuucugcacccagcucaaccgcgcccugacggggaucgccgucgagcaggacaagaacacccaggagguguucgcccaggugaagcagaucuacaagacgcccccgaucaaggacuucggcggguucaacuucagccagauccugcccgaccccuccaagcccagcaagcgguccuucaucgaggaccuccuguucaacaaggucacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccagcgcgcuccuggccgggaccaucacguccggcuggaccuucggggccggcgccgcgcugcagauccccuucgccaugcagauggccuaccgguucaacggcaucggggugacccagaacguccucuacgagaaccagaagcugaucgccaaccaguucaacagcgccaucggcaagauccaggacucccugagcuccaccgcgagcgcccucgggaagcugcaggacguggugaaccagaacgcccaggcccugaacacgcucgucaagcagcuguccagcaacuucggcgccaucuccagcgugcugaacgacauccucucccgccuggacaagguggaggcggagguccagaucgaccggcugaucaccgggcgccuccagagccugcagaccuacgugacccagcagcugauccgggccgccgagauccgcgccagcgccaaccucgcggccaccaagauguccgagugcgugcugggccagagcaagcgggucgacuucugcggcaagggguaccaccugauguccuucccccagagcgccccgcacggcgugguguuccuccacgucacguacgugcccgcccaggagaagaacuucaccaccgcgcccgccaucugccacgacgggaaggcccacuucccccgcgagggcgucuucguguccaacgggacccacugguucgugacgcagcggaacuucuacgagccgcagaucaucaccaccgacaacaccuucgucagcggcaacugcgacguggugaucggcaucgucaacaacacgguguacgacccccugcagcccgagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggccgugguacaucuggcugggcuucaucgcgggccugaucgccaucgucauggugaccaucaugcucugcugcaugaccagcugcugcuccugccugaaggggugcugcagcugcggcuccugcugcaaguucgacgaggacgacagcgagcccgugcugaagggggucaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12306 - RNA, 4094 nt, Artificial Sequence
  SARS-CoV-2/South Korea/SNU01/2020__EPI_ISL_411929 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucugggcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccgccuguuccggaaguccaaccucaagcccuucgagcgcgacaucagcaccgagaucuaccaggccggcuccacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccaggacgugaacugcaccgagguccccguggccauccacgccgaccagcugacgcccaccuggcggguguacagcaccggcuccaacgucuuccagacccgcgccgggugccucaucggcgcggagcacgugaacaacagcuacgagugcgacauccccaucggggccggcaucugcgccuccuaccagacgcagaccaacagcccgcggcgcgcccgguccguggcgagccaguccaucaucgccuacaccaugagccugggcgccgagaacuccgucgccuacagcaacaacuccaucgccauccccaccaacuucacgaucagcgugaccaccgagauccugcccguguccaugaccaagacgagcgucgacugcaccauguacaucugcggggacagcaccgagugcuccaaccuccugcugcaguacggcagcuucugcacccagcucaaccgcgcgcugacggggaucgccguggagcaggacaagaacacccaggagguguucgcccaggucaagcagaucuacaagacgcccccgaucaaggacuucggcggguucaacuucucccagauccugcccgaccccagcaagcccuccaagcggagcuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccuccgcccuccuggcggggaccaucacgagcggcuggaccuucggggccggcgccgcccugcagauccccuucgcgaugcagauggccuaccgguucaacggcaucggggucacccagaacgugcucuacgagaaccagaagcugaucgccaaccaguucaacuccgccaucggcaagauccaggacagccuguccagcaccgccuccgcgcucgggaagcugcaggacguggucaaccagaacgcccaggcccugaacacgcucgugaagcagcugagcuccaacuucggcgccaucagcuccgugcugaacgacauccucagccgccuggacaaggucgaggccgaggugcagaucgaccggcugaucaccgggcgccuccagucccugcagaccuacgugacccagcagcugauccgggcggccgagauccgcgccagcgccaaccucgccgcgaccaagaugagcgagugcguccugggccaguccaagcggguggacuucugcggcaagggguaccaccugaugagcuucccccaguccgccccgcacggcguggucuuccuccacgugacguacguccccgcccaggagaagaacuucaccaccgcccccgcgaucugccacgacgggaaggcccacuucccccgcgagggcguguucgugagcaacgggacccacugguucgucacgcagcggaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggccgugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12307 - RNA, 4094 nt, Artificial Sequence
  SARS-CoV-2/China/WF0004/2020__EPI_ISL_413694 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggacggaguccgaguuccgggucuacagcuccgccaacaacugcaccuucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacgcuccuggcccugcaccgguccuaccucaccccgggggacagcagcuccggcuggaccgcgggcgccgccgccuacuacgugggguaccugcagccccgcaccuuccugcucaaguacaacgagaacggcacgaucaccgacgcggucgacugcgcccuggacccccugagcgagaccaagugcacccucaaguccuucacgguggagaaggggaucuaccagaccagcaacuuccgggugcagcccaccgaguccaucguccgcuucccgaacaucaccaaccugugccccuucggcgagguguucaacgccacgcgguucgccagcgucuacgccuggaaccgcaagcggaucuccaacugcguggcggacuacagcgugcuguacaacuccgccagcuucuccaccuucaagugcuacggcgucagccccaccaagcucaacgaccugugcuucaccaacguguacgccgacuccuucgugauccgcggggacgagguccggcagaucgcccccggccagacggggaagaucgccgacuacaacuacaagcugccggacgacuucaccggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgacgaacggcgugggguaccagcccuaccggguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgcgguccgcgacccccagacccuggagauccucgacaucacgcccugcagcuucggcgggguguccgugaucaccccgggcaccaacaccagcaaccaggucgccgugcuguaccaggacgugaacugcacggagguccccguggccauccacgccgaccagcugacccccaccuggcggguguacuccaccggcagcaacgucuuccagacgcgcgccgggugccucaucggcgcggagcacgugaacaacuccuacgagugcgacauccccaucggggccggcaucugcgccagcuaccagacccagaccaacuccccgcggcgcgcccggagcguggcgucccagagcaucaucgccuacaccaugucccugggcgccgagaacagcgucgccuacuccaacaacagcaucgccauccccacgaacuucaccaucuccgugaccaccgagauccugcccgugagcaugacgaagaccagcgucgacugcaccauguacaucugcggggacuccaccgagugcagcaaccuccugcugcaguacggcuccuucugcacgcagcucaaccgcgcgcugaccgggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggacgaucaccuccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccacggccagcgcgcucgggaagcugcaggacguggucaaccagaacgcccaggcccugaacacccucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgacgaagauguccgagugcguccugggccagagcaagcgguucgacuucugcggcaagggguaccaccugauguccuucccccagagcgccccgcacggcgugguguuccuccacgucaccuacgugcccgcccaggagaagaacuucaccaccgcccccgcgaucugccacgacgggaaggcccacuucccccgcgagggcgucuucguguccaacgggacgcacugguucgugacccagcggaacuucuacgagccgcagaucaucaccaccgacaacacguucgucagcggcaacugcgacguggugaucggcaucgucaacaacaccguguacgacccccugcagcccgagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgcgaucgucauggugaccaucaugcucugcugcaugacgagcugcugcuccugccugaaggggugcugcagcugcggcuccugcugcaaguucgacgaggacgacagcgagcccgugcugaagggggucaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12308 - RNA, 4094 nt, Artificial Sequence
  SARS-CoV-2/China/WF0028/2020__EPI_ISL_413791 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggaguccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12309 - RNA, 4094 nt, Artificial Sequence
  SARS-CoV-2/2019-nCoV/USA-CruiseA-18/2020__MT159716.1 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccucgagggcaagcaggggaacuucaagaaccugcgcgaguucguguucaagaacaucgacggcuacuucaagaucuacuccaagcacaccccgaucaaccugguccgggaccucccccagggguucagcgcccuggagccccugguggaccuccccaucggcaucaacaucacccgcuuccagacccugcuggcccuccaccgguccuaccugacgccgggggacagcagcuccggcuggaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcucuacaacuccgccagcuucuccacguucaagugcuacggcgucagccccaccaagcugaacgaccugugcuucaccaacguguacgccgacuccuucgugauccgcggggacgagguccggcagaucgcccccggccagaccgggaagaucgccgacuacaacuacaagcucccggacgacuucacgggcugcgugaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcucagcuucgagcugcugcacgcccccgccacggugugcggccccaagaaguccaccaaccucgucaagaacaagugcgugaacuucaacuucaacggccugaccgggaccggcgugcugaccgagagcaacaagaaguuccugccguuccagcaguucgggcgcgacaucgccgacacgaccgacgcgguccgcgacccccagacccucgagauccuggacaucacccccugcagcuucggcgggguguccgugaucacgccgggcaccaacaccagcaaccaggucgccgugcuguaccaggacgugaacugcaccgagguccccguggccauccacgccgaccagcucacgcccaccuggcggguguacuccaccggcagcaacgucuuccagacccgcgccgggugccugaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccuccccgugagcaugaccaagacgagcgucgacugcaccauguacaucugcggggacuccaccgagugcagcaaccugcugcuccaguacggcuccuucugcacccagcugaaccgcgcgcugacggggaucgccguggagcaggacaagaacacccaggagguguucgcccaggucaagcagaucuacaagacgcccccgaucaaggacuucggcggguucaacuucagccagauccuccccgaccccuccaagcccagcaagcgguccuucaucgaggaccugcuguucaacaaggugacccucgccgacgccggcuucaucaagcaguacggcgacugccugggggacaucgcggcccgcgaccugaucugcgcccagaaguucaacggccucaccgugcugccgccccugcucaccgacgagaugaucgcccaguacaccagcgcccugcuggcggggaccaucacguccggcuggaccuucggggccggcgccgcccuccagauccccuucgcgaugcagauggccuaccgguucaacggcaucggggucacccagaacgugcuguacgagaaccagaagcugaucgccaaccaguucaacagcgccaucggcaagauccaggacucccucagcuccaccgccagcgcgcuggggaagcugcaggacguggucaaccagaacgcccaggcccucaacacgcuggugaagcagcuguccagcaacuucggcgccaucuccagcgugcucaacgacauccugucccgccuggacaaggucgaggccgaggugcagaucgaccggcucaucaccgggcgccugcagagccugcagaccuacgugacccagcagcucauccgggcggccgagauccgcgccagcgccaaccuggccgcgaccaagauguccgagugcguccugggccagagcaagcggguggacuucugcggcaagggguaccaccucauguccuucccccagagcgccccgcacggcguggucuuccugcacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcucgacuccuucaaggaggagcuggacaaguacuucaagaaccacaccagccccgacgucgaccugggggacaucuccggcaucaacgccagcguggugaacauccagaaggagaucgaccgccucaacgaggucgccaagaaccugaacgagucccugaucgaccuccaggagcuggggaaguacgagcaguacaucaaguggccgugguacaucuggcugggcuucaucgccggccucaucgcgaucgugauggugaccaucaugcugugcugcaugaccagcugcugcuccugccugaaggggugcugcagcugcggcuccugcugcaaguucgacgaggacgacagcgagcccguccucaagggggugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12310 - RNA, 4094 nt, Artificial Sequence
  SARS-CoV-2/SARS-CoV-2/Yunnan-01/human/2020/CHN__MT049951.1 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccaacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12311 - RNA, 4094 nt, Artificial Sequence
  SARS-CoV-2/USA/WA-UW292/2020__EPI_ISL_418077 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccagcuccacccccugcaacggcguggagggguucaacugcuacuucccccugcagagcuacggcuuccagccgaccaacggggugggcuaccagcccuaccggguggucgugcugagcuucgagcuccugcacgcccccgccacggugugcgggcccaagaaguccaccaaccuggucaagaacaagugcgugaacuucaacuucaacggccucaccggcaccggggugcugaccgagagcaacaagaaguuccugccguuccagcaguucggccgcgacaucgccgacacgaccgacgcgguccgcgacccccagacccuggagauccucgacaucacccccugcuccuucgggggcgugagcgugaucacgccggggaccaacaccuccaaccaggucgccgugcuguaccaggacgugaacugcaccgagguccccguggccauccacgccgaccagcugacgcccaccuggcggguguacagcaccggcuccaacgucuuccagacccgcgccggcugccucaucggggcggagcacgugaacaacagcuacgagugcgacauccccaucggcgccgggaucugcgccuccuaccagacgcagaccaacagcccgcggcgcgcccgguccguggcgagccaguccaucaucgccuacaccaugagccugggcgccgagaacuccgucgccuacagcaacaacuccaucgccauccccaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggguucaucaagcaguacggcgacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggggccgcccugcagauccccuucgcgaugcagauggccuaccgguucaacggcaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagagccugcagaccuacgugacccagcagcugauccgggcggccgagauccgcgccuccgccaaccucgccgcgaccaagaugagcgagugcguccuggggcaguccaagcggguggacuucugcggcaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccgggaacugcgacguggucaucggcaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggguucaucgccggccugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12312 - RNA, 4094 nt, Artificial Sequence
  SARS-CoV-2/Iceland/192/2020__EPI_ISL_417819 spike protein mRNA gc (1-1273)
aggagagucccgcagucggcguccagcggcucugcuuguucgugugugugucguugcaggccuuauucaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggaccugccccagggguucagcgcccuggagccccucguggaccugcccaucggcaucaacaucacccgcuuccagacccugcucgcccugcaccgguccuaccugacgccgggggacagcagcuccggcuggaccgcgggcgccgccgccuacuacgugggguaccuccagccccgcaccuuccugcugaaguacaacgagaacggcaccaucacggacgcggucgacugcgcccucgacccccugagcgagaccaagugcacccugaaguccuucaccguggagaaggggaucuaccagacgagcaacuuccgggugcagcccaccgaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcugaacgaccucugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccuggacuccaaggucgggggcaacuacaacuaccucuaccgccuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccggguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgcgacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcggguguacuccaccgggagcaacgucuuccagacccgcgccggcugccugaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccucggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugaccgugcugccgccccuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacaaggucgaggccgaggugcagaucgaccggcugaucaccggccgccugcagagccuccagaccuacgugacccagcagcugauccgggcggccgagauccgcgccagcgccaaccuggccgcgaccaagauguccgagugcguccucggccagagcaagcggguggacuucugcgggaagggcuaccaccugauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccuccagcccgagcuggacuccuucaaggaggagcuggacaaguacuucaagaaccacaccagccccgacgucgaccucggcgacaucuccgggaucaacgccagcguggugaacauccagaaggagaucgaccgccugaacgaggucgccaagaaccugaacgagucccucaucgaccugcaggagcugggcaaguacgagcaguacaucaaguggccgugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagcccguccugaagggcgugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12313 - RNA, 4094 nt, Artificial Sequence
  SARS-CoV-2/Belgium/ULG-6939/2020__EPI_ISL_417020 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucguguacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12314 - RNA, 4094 nt, Artificial Sequence
  SARS-CoV-2/France/HF2496/2020__EPI_ISL_418231 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucguggcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12315 - RNA, 4094 nt, Artificial Sequence
  SARS-CoV-2/USA/WA-UW291/2020__EPI_ISL_418076 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaguacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12316 - RNA, 4094 nt, Artificial Sequence
  SARS-CoV-2/Portugal/PT0034/2020__EPI_ISL_418019 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaucaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12317 - RNA, 4094 nt, Artificial Sequence
  SARS-CoV-2/Iceland/202/2020__EPI_ISL_417750 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucccgggcaucaacgccuccguggugaacauccagaaggagaucgaccgccugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12318 - RNA, 4094 nt, Artificial Sequence
  SARS-CoV-2/USA/WA-UW261/2020__EPI_ISL_418046 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucacgagcgucuacgccuggaaccgcaagcggaucuccaacugcguggccgacuacagcgugcuguacaacuccgcgagcuucuccaccuucaagugcuacggcgucagccccaccaagcucaacgaccugugcuucaccaacguguacgccgacuccuucgugauccgcggggacgagguccggcagaucgcccccggccagacggggaagaucgccgacuacaacuacaagcugccggacgacuucaccggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgacgaacggcgugggguaccagcccuaccggguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgccguccgcgacccccagacccuggagauccucgacaucacgcccugcagcuucggcgggguguccgugaucaccccgggcaccaacaccagcaaccaggucgcggugcuguaccaggacgugaacugcacggagguccccguggccauccacgccgaccagcugacccccaccuggcggguguacuccaccggcagcaacgucuuccagacgcgcgccgggugccucaucggcgccgagcacgugaacaacuccuacgagugcgacauccccaucggggcgggcaucugcgccagcuaccagacccagaccaacuccccgcggcgcgcccggagcguggccucccagagcaucaucgcguacaccaugucccugggcgccgagaacagcgucgccuacuccaacaacagcaucgccauccccacgaacuucaccaucuccgugaccaccgagauccugcccgugagcaugacgaagaccagcgucgacugcaccauguacaucugcggggacuccaccgagugcagcaaccuccugcugcaguacggcuccuucugcacgcagcucaaccgcgcccugaccgggaucgcgguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgccgcgcgcgaccugaucugcgcccagaaguucaacggccugaccgugcucccgccccugcugaccgacgagaugaucgcccaguacaccagcgcccuccuggccgggacgaucaccuccggcuggaccuucggggcgggcgccgcccugcagauccccuucgccaugcagauggcguaccgguucaacggcaucggggucacccagaacgugcucuacgagaaccagaagcugaucgccaaccaguucaacagcgccaucggcaagauccaggacucccugagcuccacggccagcgcccucgggaagcugcaggacguggucaaccagaacgcgcaggcccugaacacccucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggccgcggagauccgcgccagcgccaaccucgccgccacgaagauguccgagugcguccugggccagagcaagcggguggacuucugcggcaagggguaccaccugauguccuucccccagagcgcgccgcacggcguggucuuccuccacgugaccuacguccccgcccaggagaagaacuucaccaccgcccccgccaucugccacgacgggaaggcgcacuucccccgcgagggcguguucguguccaacgggacgcacugguucgucacccagcggaacuucuacgagccgcagaucaucaccaccgacaacacguucgugagcggcaacugcgacguggucaucggcaucgugaacaacaccguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgccaucgugauggugaccaucaugcucugcugcaugacgagcugcugcuccugccugaaggggugcugcagcugcggcuccugcugcaaguucgacgaggacgacagcgagcccguccugaagggggugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12319 - RNA, 4094 nt, Artificial Sequence
  SARS-CoV-2/Portugal/PT0035/2020__EPI_ISL_418020 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucagcgcgcgcgaccugaucugcgcccagaaguucaacggccugaccgugcucccgccccugcugaccgacgagaugaucgcccaguacaccuccgcccuccuggccgggaccaucacgagcggcuggaccuucggggcgggcgccgcccugcagauccccuucgccaugcagauggcguaccgguucaacggcaucggggucacccagaacgugcucuacgagaaccagaagcugaucgccaaccaguucaacuccgccaucggcaagauccaggacagccuguccagcaccgccuccgcccucgggaagcugcaggacguggucaaccagaacgcgcaggcccugaacacgcucgugaagcagcugagcuccaacuucggcgccaucagcuccgugcugaacgacauccucagccgccuggacaaggucgaggccgaggugcagaucgaccggcugaucaccgggcgccuccagagccugcagaccuacgugacccagcagcugauccgggccgcggagauccgcgccuccgccaaccucgccgccaccaagaugagcgagugcguccugggccaguccaagcggguggacuucugcggcaagggguaccaccugaugagcuucccccaguccgcgccgcacggcguggucuuccuccacgugacguacguccccgcccaggagaagaacuucaccaccgcccccgccaucugccacgacgggaaggcgcacuucccccgcgagggcguguucgugagcaacgggacccacugguucgucacgcagcggaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggccgugguacaucuggcugggcuucaucgccggccugaucgccaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12320 - RNA, 4094 nt, Artificial Sequence
  SARS-CoV-2/USA/NY-NYUMC7/2020__EPI_ISL_418192 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12321 - RNA, 4094 nt, Artificial Sequence
  SARS-CoV-2/Iceland/189/2020__EPI_ISL_417709 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaccaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcacgaucaccuccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccacggccagcgcgcucggcaagcugcaggacguggucaaccagaacgcccaggcccugaacacccucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgacgaagauguccgagugcguccugggccagagcaagcggguggacuucugcgggaagggcuaccaccugauguccuucccccagagcgccccgcacgggguggucuuccuccacgugaccuacguccccgcccaggagaagaacuucaccaccgcccccgcgaucugccacgacggcaaggcccacuucccccgcgaggggguguucguguccaacggcacgcacugguucgucacccagcggaacuucuacgagccgcagaucaucaccaccgacaacacguucgugagcggcaacugcgacguggucaucgggaucgugaacaacaccguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugacgagcugcugcuccugccugaagggcugcugcagcugcggguccugcugcaaguucgacgaggacgacagcgagcccguccugaagggcgugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12322 - RNA, 4094 nt, Artificial Sequence
  SARS-CoV-2/Australia/NSW56/2020__EPI_ISL_417408 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgacuccagcaagcccuccaagcggagcuucaucgaggaccuccuguucaacaaggugacccuggccgacgccggcuucaucaagcaguacggcgacugccucggggacaucgcggcccgcgaccugaucugcgcccagaaguucaacggccugaccgugcugcccccgcuccugaccgacgagaugaucgcccaguacaccuccgcccuccuggcggggaccaucacgagcggcuggaccuucggggccggcgccgcccugcagauccccuucgcgaugcagauggccuaccgguucaacggcaucggggucacccagaacgugcucuacgagaaccagaagcugaucgccaaccaguucaacuccgccaucggcaagauccaggacagccuguccagcaccgccuccgcgcucgggaagcugcaggacguggucaaccagaacgcccaggcccugaacacgcucgugaagcagcugagcuccaacuucggcgccaucagcuccgugcugaacgacauccucagccgccuggacaaggucgaggccgaggugcagaucgaccggcugaucaccgggcgccuccagagccugcagaccuacgugacccagcagcugauccgggcggccgagauccgcgccuccgccaaccucgccgcgaccaagaugagcgagugcguccugggccaguccaagcggguggacuucugcggcaagggguaccaccugaugagcuucccccaguccgcgccccacggcguggucuuccuccacgugacguacgucccggcccaggagaagaacuucaccaccgcccccgccaucugccacgacgggaaggcccacuucccccgcgagggcguguucgugagcaacgggacccacugguucgucacgcagcggaacuucuacgagccccagaucaucaccaccgacaacaccuucguguccggcaacugcgacguggucaucggcaucgugaacaacacgguguacgacccgcugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagccgguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12323 - RNA, 4094 nt, Artificial Sequence
  SARS-CoV-2/Iceland/280/2020__EPI_ISL_417608 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccacacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12324 - RNA, 4094 nt, Artificial Sequence
  SARS-CoV-2/Iceland/247/2020__EPI_ISL_417575 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12325 - RNA, 4094 nt, Artificial Sequence
  SARS-CoV-2/Iceland/238/2020__EPI_ISL_417566 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgugggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12326 - RNA, 4094 nt, Artificial Sequence
  SARS-CoV-2/Greece/16/2020__EPI_ISL_418265 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacgucgacggcuacuucaagaucuacuccaagcacaccccgaucaaccuggugcgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgucggguaccugcagccccgcaccuuccugcucaaguacaacgagaacggcaccaucacggacgcgguggacugcgcccuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgcggugcgcgacccccagacccuggagauccucgacaucacccccugcagcuucggcgggguguccgucaucacgccgggcaccaacaccagcaaccagguggccgugcuguaccaggacgucaacugcaccgaggugcccguggccauccacgccgaccagcugacgcccaccuggcgggucuacuccaccggcagcaacguguuccagacccgcgccgggugccucaucggcgcggagcacgugaacaacuccuacgagugcgacauccccaucggggccggcaucugcgccagcuaccagacgcagaccaacuccccgcggcgcgcccggagcgucgcgucccagagcaucaucgccuacaccaugucccugggcgccgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgcgcgcugacggggaucgccguggagcaggacaagaacacccaggaggucuucgcccaggugaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccguccucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggugacccagaacgugcucuacgagaaccagaagcugaucgccaaccaguucaacagcgccaucggcaagauccaggacucccugagcuccaccgccagcgcgcucgggaagcugcaggacgucgugaaccagaacgcccaggcccugaacacgcucgugaagcagcuguccagcaacuucggcgccaucuccagcguccugaacgacauccucucccgccuggacaagguggaggccgaggugcagaucgaccggcugaucaccgggcgccuccagagccugcagaccuacgucacccagcagcugauccgggcggccgagauccgcgccagcgccaaccucgccgcgaccaagauguccgagugcgugcugggccagagcaagcggguggacuucugcggcaagggguaccaccugauguccuucccccagagcgccccgcacggcgucguguuccuccacgucacguacgugcccgcccaggagaagaacuucaccaccgcccccgcgaucugccacgacgggaaggcccacuucccccgcgagggcguguucgucuccaacgggacccacugguucgugacgcagcggaacuucuacgagccgcagaucaucaccaccgacaacaccuucgugagcggcaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgcgaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12327 - RNA, 4094 nt, Artificial Sequence
  SARS-CoV-2/Iceland/319/2020__EPI_ISL_417648 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugaucgaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12328 - RNA, 4094 nt, Artificial Sequence
  SARS-CoV-2/Congo/94/2020__EPI_ISL_417947 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggacauccucuucaacaaggugacccuggccgacgccggcuucaucaagcaguacggggacugccugggcgacaucgcggcccgcgaccucaucugcgcccagaaguucaacgggcugaccgugcugccgccccuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacaaggucgaggccgaggugcagaucgaccggcugaucaccggccgccugcagagccuccagaccuacgugacccagcagcugauccgggcggccgagauccgcgccagcgccaaccuggccgcgaccaagauguccgagugcguccucggccagagcaagcggguggacuucugcgggaagggcuaccaccugauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccuccagcccgagcuggacuccuucaaggaggagcuggacaaguacuucaagaaccacaccagccccgacgucgaccucggcgacaucuccgggaucaacgccagcguggugaacauccagaaggagaucgaccgccugaacgaggucgccaagaaccugaacgagucccucaucgaccugcaggagcugggcaaguacgagcaguacaucaaguggccgugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagcccguccugaagggcgugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12329 - RNA, 4094 nt, Artificial Sequence
  SARS-CoV-2/Congo/158/2020__EPI_ISL_417950 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuuccugagcggcaacugcgacguggugaucggcaucgucaacaacacgguguacgacccccugcagcccgagcucgacuccuucaaggaggagcuggacaaguacuucaagaaccacaccagccccgacguggaccugggggacaucuccggcaucaacgccagcgucgugaacauccagaaggagaucgaccgccucaacgagguggccaagaaccugaacgagucccugaucgaccuccaggagcuggggaaguacgagcaguacaucaaguggccgugguacaucuggcugggcuucaucgccggccucaucgcgaucgucauggugaccaucaugcugugcugcaugaccagcugcugcuccugccugaaggggugcugcagcugcggcuccugcugcaaguucgacgaggacgacagcgagcccgugcucaagggggucaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12330 - RNA, 4094 nt, Artificial Sequence
  SARS-CoV-2/USA/UT-00034/2020__EPI_ISL_417977 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuacuacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12331 - RNA, 4094 nt, Artificial Sequence
  SARS-CoV-2/USA/UT-00033/2020__EPI_ISL_417976 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcucuacaacuccgccagcuucuccacguucaagugcuacggcgucagccccaccaagcugaacgaccugugcuucaccaacguguacgccgacuccuucgugauccgcggggacgagguccggcagaucgcccccggccagaccgggaagaucgccgacuacaacuacaagcucccggacgacuucacgggcugcgugaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcucagcuucgagcugcugcacgcccccgccacggugugcggccccaagaaguccaccaaccucgucaagaacaagugcgugaacuucaacuucaacggccugaccgggaccggcgugcugaccgagagcaacaagaaguuccugccguuccagcaguucgggcgcgacaucgccgacacgaccgacgcgguccgcgacccccagacccucgagauccuggacaucacccccugcagcuucggcgggguguccgugaucacgccgggcaccaacaccagcaaccaggucgccgugcuguaccagggcgugaacugcaccgagguccccguggccauccacgccgaccagcucacgcccaccuggcggguguacuccaccgggagcaacgucuuccagacccgcgccggcugccugaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccuccccgugagcaugaccaagacgagcgucgacugcaccauguacaucugcggcgacuccaccgagugcagcaaccugcugcuccaguacggguccuucugcacccagcugaaccgcgcgcugacgggcaucgccguggagcaggacaagaacacccaggagguguucgcccaggucaagcagaucuacaagacgcccccgaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucaccgugcugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgucacccagaacgugcuguacgagaaccagaagcugaucgccaaccaguucaacagcgccaucgggaagauccaggacucccucagcuccaccgccagcgcgcugggcaagcugcaggacguggucaaccagaacgcccaggcccucaacacgcuggugaagcagcuguccagcaacuucggggccaucuccagcgugcucaacgacauccugucccgccuggacaaggucgaggccgaggugcagaucgaccggcucaucaccggccgccugcagagccugcagaccuacgugacccagcagcucauccgggcggccgagauccgcgccagcgccaaccuggccgcgaccaagauguccgagugcguccugggccagagcaagcggguggacuucugcgggaagggcuaccaccucauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcucgacuccuucaaggaggagcuggacaaguacuucaagaaccacaccagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12332 - RNA, 4094 nt, Artificial Sequence
  SARS-CoV-2/USA/WI-13/2020__EPI_ISL_417516 spike protein mRNA gc (1-1273)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcugcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcucuacaacuccgccagcuucuccacguucaagugcuacggcgucagccccaccaagcugaacgaccugugcuucaccaacguguacgccgacuccuucgugauccgcggggacgagguccggcagaucgcccccggccagaccgggaagaucgccgacuacaacuacaagcucccggacgacuucacgggcugcgugaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcucagcuucgagcugcugcacgcccccgccacggugugcggccccaagaaguccaccaaccucgucaagaacaagugcgugaacuucaacuucaacggccugaccgggaccggcgugcugaccgagagcaacaagaaguuccugccguuccagcaguucgggcgcgacaucgccgacacgaccgacgcgguccgcgacccccagacccucgagauccuggacaucacccccugcagcuucggcgggguguccgugaucacgccgggcaccaacaccagcaaccaggucgccgugcuguaccagggcgugaacugcaccgagguccccguggccauccacgccgaccagcucacgcccaccuggcggguguacuccaccgggagcaacgucuuccagacccgcgccggcugccugaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccuccccgugagcaugaccaagacgagcgucgacugcaccauguacaucugcggcgacuccaccgagugcagcaaccugcugcuccaguacggguccuucugcacccagcugaaccgcgcgcugacgggcaucgccguggagcaggacaagaacacccaggagguguucgcccaggucaagcagaucuacaagacgcccccgaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucaccgugcugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgucacccagaacgugcuguacgagaaccagaagcugaucgccaaccaguucaacagcgccaucgggaagauccaggacucccucagcuccaccgccagcgcgcugggcaagcugcaggacguggucaaccagaacgcccaggcccucaacacgcuggugaagcagcuguccagcaacuucggggccaucuccagcgugcucaacgacauccugucccgccuggacaaggucgaggccgaggugcagaucgaccggcucaucaccggccgccugcagagccugcagaccuacgugacccagcagcucauccgggcggccgagauccgcgccagcgccaaccuggccgcgaccaagauguccgagugcguccugggccagagcaagcggguggacuucugcgggaagggcuaccaccucauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcucgacuccuucaaggaggagcuggacaaguacuucaagaaccacaccagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12333 - RNA, 4091 nt, Artificial Sequence
  SARS-CoV-2/India/1-27/2020__EPI_ISL_413522 spike protein mRNA gc (1-1272)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgaggucauccagaucgcccccggccagaccgggaagaucgccgacuacaacuacaagcugccggacgacuucacgggcugcgugaucgcguggaacagcaacaaccucgacuccaaggucgggggcaacuacaacuaccuguaccggcuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgggacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggggccggcaucugcgccagcuaccagacgcagaccaacuccccgcgccgggcccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgggcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgcuccuucaucgaggaccuccuguucaacaaggugacccuggccgacgccggcuucaucaagcaguacggcgacugccucggggacaucgcggcccgggaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgcuucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccggcuggacaaggucgaggccgaggugcagaucgaccgccugaucaccgggcggcuccagagccugcagaccuacgugacccagcagcugauccgcgcggccgagauccgggccagcgccaaccucgccgcgaccaagauguccgagugcguccugggccagagcaagcgcguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgggagggcguguucguguccaacgggacccacugguucgucacgcagcgcaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12334 - RNA, 4076 nt, Artificial Sequence
  SARS-CoV-2/pangolin/Guangxi/P4L/2017__EPI_ISL_410538 spike protein mRNA gc (1-1267)
aggagagucccgcagucggcguccagcggcucugcuuguucgugugugugucguugcaggccuuauucaagcuuaccauguucguguuccuguucguccucccccuggugagcucccagugcgugaaccugaccacccgcacgggcaucccgcccggguacaccaacagcuccacccggggcgucuacuaccccgacaagguguuccgcagcuccauccuccaccugacccaggaccuguuccuccccuucuucagcaacgugacgugguucaacaccaucaacuaccagggcggguucaagaaguucgacaacccgguccugcccuucaacgacgggguguacuucgccuccaccgagaaguccaacaucauccggggcuggaucuucggcaccacgcuggacgcccgcacccagagccuccugaucgugaacaacgcgaccaacgucgugaucaaggugugcgaguuccaguucugcaccgaccccuuccugggggucuacuaccacaacaacaacaagacguggguggagaacgaguuccggguguacagcuccgccaacaacugcaccuucgaguacaucagccagcccuuccucauggaccuggagggcaagcaggggaacuucaagaaccugcgcgaguucgucuucaagaacguggacggcuacuucaagaucuacuccaagcacaccccgaucgaccucgugcgggaccugccccgcggguucgccgcccuggagccccucgucgaccugcccaucggcaucaacaucacccgguuccagacgcugcucgcccugcaccgcagcuaccugaccccgggcaaccucgaguccggguggaccaccggcgcggccgccuacuacgugggguaccugcagcagcggacguuccugcucagcuacaaccagaacggcaccaucaccgacgccguggacugcucccuggacccccugagcgagaccaagugcacgcucaagucccugaccgucgagaagggcaucuaccagaccagcaacuuccgcgugcagcccaccaucagcaucgugcgguuccccaacaucacgaaccugugcccguucggggaggucuucaacgcguccaaguucgccagcguguacgccuggaaccgcaagcggaucuccaacugcgucgccgacuacagcgugcucuacaacuccaccagcuucuccaccuucaagugcuacggcgugagccccaccaagcugaacgaccugugcuucacgaacgucuacgccgacuccuucguggugaagggggacgagguccgccagaucgcgcccggccagaccggggugaucgccgacuacaacuacaagcuccccgacgacuucaccggcugcgugaucgccuggaacagcgucaagcaggacgcccugaccggcgggaacuacggcuaccuguaccgccucuuccggaaguccaagcugaagccguucgagcgggacaucagcacggagaucuaccaggccggguccacccccugcaacggccagguggggcugaacugcuacuacccccucgagcgcuacggcuuccaccccaccaccggcgugaacuaccagccguuccgggucguggugcugagcuucgagcugcucaacgggcccgcgaccgucugcggccccaagcuguccacgacccuggugaaggacaagugcgugaacuucaacuucaacgggcugaccggcaccgggguccucacgaccagcaagaagcaguuccugcccuuccagcaguucggccgcgacaucuccgacaccaccgacgccgugcgcgacccgcagacgcuggagauccucgacaucacccccugcagcuucggcgggguguccgucaucacccccggcaccaacacgagcaaccagguggccgugcuguaccaggacgucaacugcaccgaggugccgauggccauccacgccgagcagcugacccccgcguggcggguguacagcgccggggccaacgucuuccagacccgcgccggcugccucgugggcgccgagcacgugaacaacuccuacgagugcgacauccccgucggggcgggcaucugcgccagcuaccacuccaugagcucccugcggagcgugaaccagcgcuccaucaucgccuacacgaugagccugggggccgagaacuccguggcguacagcaacaacuccaucgccauccccaccaacuucaccaucagcgucaccacggagauccucccgguguccaugaccaagaccagcguggacugcaccauguacaucugcggcgacuccaucgagugcagcaaccugcugcuccaguacggguccuucugcacgcagcugaaccgggcccugaccggcaucgccgucgagcaggacaagaacacccaggagguguucgcccaggugaagcagaucuacaagaccccgcccaucaaggacuucggcggguucaacuucagccagauccuccccgaccccagcaagcccuccaagcgcagcuucaucgaggaccugcuguucaacaaggucacgcucgcggacgccggcuucaucaagcaguacggggacugccugggcgacaucgccgcccgggaccugaucugcgcccagaaguucaacgggcucaccgugcugccgccccugcucaccgacgagaugaucgcgcaguacaccuccgcccugcuggccggcacgaucaccagcggcuggaccuucggggccggcgccgcgcuccagauccccuucgccaugcagauggccuaccgcuucaacgggaucggcgugacccagaacguccuguacgagaaccagaagcugaucgccaaccaguucaacuccgcgaucgggaagauccaggacagccucuccagcacggccuccgcccugggcaagcugcaggacguggugaaccagaacgcccaggcccucaacacccuggucaagcagcugagcuccaacuucggcgcgaucagcuccgugcucaacgacauccugagccggcuggacaagguggaggccgagguccagaucgaccgccucaucaccgggcggcugcagucccugcagaccuacgugacccagcagcucauccgcgccgccgagauccgggccagcgcgaaccuggccgccacgaagauguccgagugcgugcugggccagagcaagcgcgucgacuucugcgggaagggcuaccaccucauguccuucccccagagcgcgccccacgggguggucuuccugcacgugaccuacgugcccgcccaggagaagaacuucaccaccgccccggccaucugccacgagggcaaggcccacuucccccgggagggcgucuucgugagcaacgggacgcacugguucaucacccagcgcaacuucuacgagccccagaucaucaccaccgacaacacguucguguccggcagcugcgacgucgugaucgggaucgugaacaacaccgucuacgacccccugcagccggagcucgacuccuucaaggaggagcuggacaaguacuucaagaaccacaccagccccgacguggaccugggcgacaucuccggcaucaacgccagcguggucaacauccagaaggagaucgaccggcucaacgagguggcgaagaaccugaacgagucccccaucgaccugcaggagcucgggaaguacgagcaguacaucaaguggcccugguacaucuggcugggcuucaucgccgggcugaucgccaucaucauggugaccaucaugcucugcugcaugacgagcugcugcuccugccugaagggcugcugcagcugcggguccugcugcaaguucgacgaggacgacagcgagccgguccugaagggcgugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12335 - RNA, 4076 nt, Artificial Sequence
  SARS-CoV-2/pangolin/Guangxi/P5L/2017__EPI_ISL_410540 spike protein mRNA gc (1-1267)
aggagagucccgcagucggcguccagcggcucugcuuguucgugugugugucguugcaggccuuauucaagcuuaccauguucguguuccuguucguccucccccuggugagcucccagugcgugaaccugaccacccgcacgggcaucccgcccggguacaccaacagcuccacccggggcgucuacuaccccgacaagguguuccgcagcuccauccuccaccugacccaggaccuguuccuccccuucuucagcaacgugacgugguucaacaccaucaacuaccagggcggguucaagaaguucgacaacccgguccugcccuucaacgacgggguguacuucgccuccaccgagaaguccaacaucauccggggcuggaucuucggcaccacgcuggacgcccgcacccagagccuccugaucgugaacaacgcgaccaacgucgugaucaaggugugcgaguuccaguucugcaccgaccccuuccugggggucuacuaccacaacaacaacaagacguggguggagaacgaguuccggguguacagcuccgccaacaacugcaccuucgaguacaucagccagcccuuccucauggaccuggagggcaagcaggggaacuucaagaaccugcgcgaguucgucuucaagaacguggacggcuacuucaagaucuacuccaagcacaccccgaucgaccucgugcgggaccugccccgcggguucgccgcccuggagccccucgucgaccugcccaucggcaucaacaucacccgguuccagacgcugcucgcccugcaccgcagcuaccugaccccgggcaagcucgaguccggguggaccaccggcgcggccgccuacuacgugggguaccugcagcagcggacguuccugcucagcuacaaccagaacggcaccaucaccgacgccguggacugcucccuggacccccugagcgagaccaagugcacgcucaagucccugaccgucgagaagggcaucuaccagaccagcaacuuccgcgugcagcccaccaucagcaucgugcgguuccccaacaucacgaaccugugcccguucggggaggucuucaacgcguccaaguucgccagcguguacgccuggaaccgcaagcggaucuccaacugcgucgccgacuacagcgugcucuacaacuccaccagcuucuccaccuucaagugcuacggcgugagccccaccaagcugaacgaccugugcuucacgaacgucuacgccgacuccuucguggugaagggggacgagguccgccagaucgcgcccggccagaccggggugaucgccgacuacaacuacaagcuccccgacgacuucaccggcugcgugaucgccuggaacagcgucaagcaggacgcccugaccggcgggaacuacggcuaccuguaccgccucuuccggaaguccaagcugaagccguucgagcgggacaucagcacggagaucuaccaggccggguccacccccugcaacggccagguggggcugaacugcuacuacccccucgagcgcuacggcuuccaccccaccaccggcgugaacuaccagccguuccgggucguggugcugagcuucgagcugcucaacgggcccgcgaccgucugcggccccaagcuguccacgacccuggugaaggacaagugcgugaacuucaacuucaacgggcugaccggcaccgggguccucacgaccagcaagaagcaguuccugcccuuccagcaguucggccgcgacaucuccgacaccaccgacgccgugcgcgacccgcagacgcuggagauccucgacaucacccccugcagcuucggcgggguguccgucaucacccccggcaccaacacgagcaaccagguggccgugcuguaccaggacgucaacugcaccgaggugccgauggccauccacgccgagcagcugacccccgcguggcggguguacagcgccggggccaacgucuuccagacccgcgccggcugccucgugggcgccgagcacgugaacaacuccuacgagugcgacauccccgucggggcgggcaucugcgccagcuaccacuccaugagcuccuuccggagcgugaaccagcgcuccaucaucgccuacacgaugagccugggggccgagaacuccguggcguacagcaacaacuccaucgccauccccaccaacuucaccaucagcgucaccacggagauccugccgguguccaugaccaagaccagcguggacugcaccauguacaucugcggcgacuccaucgagugcagcaaccuccugcugcaguacggguccuucugcacgcagcucaaccgggcccugaccggcaucgccgucgagcaggacaagaacacccaggagguguucgcccaggugaagcagaucuacaagaccccgcccaucaaggacuucggcggguucaacuucagccagauccugcccgaccccagcaagcccuccaagcgcagcuucaucgaggaccuccuguucaacaaggucacgcuggcggacgccggcuucaucaagcaguacggggacugccucggcgacaucgccgcccgggaccugaucugcgcccagaaguucaacgggcugaccgugcucccgccccugcugaccgacgagaugaucgcgcaguacaccuccgcccuccuggccggcacgaucaccagcggcuggaccuucggggccggcgccgcgcugcagauccccuucgccaugcagauggccuaccgcuucaacgggaucggcgugacccagaacguccucuacgagaaccagaagcugaucgccaaccaguucaacuccgcgaucgggaagauccaggacagccuguccagcacggccuccgcccucggcaagcugcaggacguggugaaccagaacgcccaggcccugaacacccucgucaagcagcugagcuccaacuucggcgcgaucagcuccgugcugaacgacauccucagccggcuggacaagguggaggccgagguccagaucgaccgccugaucaccgggcggcuccagucccugcagaccuacgugacccagcagcugauccgcgccgccgagauccgggccagcgcgaaccucgccgccacgaagauguccgagugcgugcugggccagagcaagcgcgucgacuucugcgggaagggcuaccaccugauguccuucccccagagcgcgccccacgggguggucuuccuccacgugaccuacgugcccgcccaggagaagaacuucaccaccgccccggccaucugccacgagggcaaggcccacuucccccgggagggcgucuucgugagcaacgggacgcacugguucaucacccagcgcaacuucuacgagccccagaucaucaccaccgacaacacguucguguccggcagcugcgacgucgugaucgggaucgugaacaacaccgucuacgacccccugcagccggagcuggacuccuucaaggaggagcucgacaaguacuucaagaaccacaccagccccgacguggaccugggcgacaucuccggcaucaacgccagcguggucaacauccagaaggagaucgaccggcugaacgagguggcgaagaaccucaacgagucccugaucgaccugcaggagcucgggaaguacgagcaguacaucaaguggcccugguacaucuggcugggcuucaucgccgggcugaucgccaucaucauggugaccaucaugcucugcugcaugacgagcugcugcuccugccugaagggcugcugcagcugcggguccugcugcaaguucgacgaggacgacagcgagcccguccugaagggcgugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12336 - RNA, 4076 nt, Artificial Sequence
  SARS-CoV-2/pangolin/Guangxi/P5E/2017__EPI_ISL_410541 spike protein mRNA gc (1-1267)
aggagagucccgcagucggcguccagcggcucugcuuguucgugugugugucguugcaggccuuauucaagcuuaccauguucguguuccuguucguccucccccuggugagcucccagugcgugaaccugaccacccgcacgggcaucccgcccggguacaccaacagcuccacccggggcgucuacuaccccgacaagguguuccgcagcuccauccuccaccugacccaggaccuguuccuccccuucuucagcaacgugacgugguucaacaccaucaccuaccagggcggguccaagaaguucgacaacccgguccugcccuucaacgacgggguguacuucgccagcaccgagaaguccaacaucauccggggcuggaucuucggcacgacccuggacgcccgcacccagagccuccugaucgugaacaacgcgaccaacgucgugaucaaggugugcgaguuccaguucugcacggaccccuuccugggggucuacuaccacaacaacaacaagaccuggguggagaacgaguuccggguguacuccagcgccaacaacugcaccuucgaguacaucucccagcccuuccucauggaccuggagggcaagcaggggaacuucaagaaccugcgcgaguucgucuucaagaacguggacggcuacuucaagaucuacagcaagcacaccccgaucgaccucgugcgggaccugccccgcggguucgccgcccuggagccccucgucgaccugcccaucggcaucaacaucacgcgguuccagacccugcucgcccugcaccgcuccuaccugaccccgggcaagcucgagagcggguggaccacgggcgcggccgccuacuacgugggguaccugcagcagcggaccuuccugcucuccuacaaccagaacggcaccaucaccgacgccguggacugcagccuggacccccuguccgagacgaagugcacccucaagagccugaccgucgagaagggcaucuaccagaccagcaacuuccgcgugcagcccacgaucuccaucgugcgguuccccaacaucaccaaccugugcccguucggggaggucuucaacgcgagcaaguucgccuccguguacgccuggaaccgcaagcggaucagcaacugcgucgccgacuacuccgugcucuacaacagcaccuccuucagcaccuucaagugcuacggcgugucccccacgaagcugaacgaccugugcuucaccaacgucuacgccgacagcuucguggugaagggggacgagguccgccagaucgcgcccggccagaccggggugaucgccgacuacaacuacaagcuccccgacgacuucaccggcugcgugaucgccuggaacuccgucaagcaggacgcccugacgggcgacaacuacggguaccuguaccggcuguuccgcaagagcaagcucaagccguucgagcgggacaucuccaccgagaucuaccaggccggcagcacccccugcaacggccagguggggcugaacugcuacuacccccucgagcgcuacggguuccaccccaccaccggcgugaacuaccagccguuccgggucguggugcuguccuucgagcugcucaacggccccgcgacggucugcgggcccaagcugagcaccacccuggugaaggacaagugcgugaacuucaacuucaacggccugaccgggacgggcguccucaccaccuccaagaagcaguuccugcccuuccagcaguucgggcgcgacaucagcgacaccacggacgccgugcgcgacccgcagacccuggagauccucgacaucacccccugcuccuucggcggcgugagcgucaucacccccgggacgaacaccagcaaccagguggccgugcuguaccaggacgucaacugcaccgaggugccgauggccauccacgccgagcagcugacccccgcguggcggguguacuccgccggcgccaacgucuuccagacgcgcgccgggugccucgugggcgccgagcacgugaacaacagcuacgagugcgacauccccgucggcgcggggaucugcgccuccuaccacagcauguccagcuuccgguccgugaaccagcgcagcaucaucgccuacaccaugucccugggcgccgagaacagcguggcguacuccaacaacagcaucgccauccccaccaacuucaccaucuccgucacgaccgagauccugccggugagcaugaccaagaccuccguggacugcacgauguacaucugcggggacagcaucgagugcuccaaccuccugcugcaguacggcagcuucugcacccagcucaaccgggcccugaccgggaucgccgucgagcaggacaagaacacccaggagguguucgcccaggugaagcagaucuacaagacgccgcccaucaaggacuucggcggcuucaacuucagccagauccugcccgaccccuccaagcccagcaagcgcuccuucaucgaggaccuccuguucaacaaggucacccuggcggacgccggguucaucaagcaguacggcgacugccucggggacaucgccgcccgggaccugaucugcgcccagaaguucaacggccugaccgugcucccgccccugcugaccgacgagaugaucgcgcaguacacgagcgcccuccuggccgggaccaucaccuccggcuggaccuucggcgccggggccgcgcugcagauccccuucgccaugcagauggccuaccgcuucaacggcaucggggugacgcagaacguccucuacgagaaccagaagcugaucgccaaccaguucaacagcgcgaucggcaagauccaggacucccugagcuccaccgccagcgcccucgggaagcugcaggacguggugaaccagaacgcccaggcccugaacacccucgucaagcagcuguccagcaacuucggcgcgaucuccagcgugcugaacgacauccucucccggcuggacaagguggaggccgagguccagaucgaccgccugaucaccggccggcuccagagccugcagaccuacgugacgcagcagcugauccgcgccgccgagauccgggccuccgcgaaccucgccgccaccaagaugagcgagugcgugcuggggcaguccaagcgcgucgacuucugcggcaagggguaccaccugaugagcuucccccagagcgcgccccacggcguggucuuccuccacgugaccuacgugcccgcccaggagaagaacuucaccacggccccggccaucugccacgaggggaaggcccacuucccccgggagggcgucuucguguccaacggcacccacugguucaucacccagcgcaacuucuacgagccccagaucaucaccacggacaacaccuucgugagcggguccugcgacgucgugaucggcaucgugaacaacaccgucuacgacccccugcagccggagcuggacagcuucaaggaggagcucgacaaguacuucaagaaccacaccucccccgacguggaccugggggacaucagcggcaucaacgccuccguggucaacauccagaaggagaucgaccggcugaacgagguggcgaagaaccucaacgagagccugaucgaccugcaggagcucggcaaguacgagcaguacaucaaguggcccugguacaucuggcugggguucaucgccggccugaucgccaucaucauggugacgaucaugcucugcugcaugaccuccugcugcagcugccugaaggggugcugcuccugcggcagcugcugcaaguucgacgaggacgacuccgagcccguccugaagggggugaagcuccacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12337 - RNA, 4070 nt, Artificial Sequence
  SARS-CoV-2/pangolin/Guangxi/P1E/2017__EPI_ISL_410539 spike protein mRNA gc (1-1265)
aggagagucccgcagucggcguccagcggcucugcuuguucgugugugugucguugcaggccuuauucaagcuuaccauguucguguuccuguucguccucccccuggugagcucccagugcgugaaccugaccacccgcacgggcauccagccgggguacaccaacagcuccacccggggcgucuacuaccccgacaagguguuccgcagcuccauccuccaccugacccaggaccuguuccuccccuucuucagcaacgugacgugguucaacaccaucaacuaccagggcggguucaagaaguucgacaaccccguccugccguucaacgacgggguguacuucgccuccaccgagaaguccaacaucauccggggcuggaucuucggcaccacgcuggacgcccgcacccagagccuccugaucgugaacaacgcgaccaacgucgugaucaaggugugcgaguuccaguucugcaccgaccccuuccugggggucuacuaccacaacaacaacaagacguggguggagaacgaguuccggguguacagcuccgccaacaacugcaccuucgaguacaucagccagcccuuccucauggaccuggagggcaagcaggggaacuucaagaaccugcgcgaguucgucuucaagaacguggacggcuacuucaagaucuacuccaagcacacccccaucgaccucgugcgggaccugccgcgcggguucgccgcccuggagccccucgucgaccugcccaucggcaucaacaucacccgguuccagacgcugcucgcccugcaccgcagcuaccugacccccggcaagcucgaguccggguggaccaccggcgcggccgccuacuacgugggguaccugcagcagcggacguuccugcucagcuacaaccagaacggcaccaucaccgacgccguggacugcucccuggacccgcugagcgagaccaagugcacgcucaagucccugaccgucgagaagggcaucuaccagaccagcaacuuccgcgugcagcccaccaucagcaucgugcgguuccccaacaucacgaaccugugccccuucggggaggucuucaacgcguccaaguucgccagcguguacgccuggaaccgcaagcggaucuccaacugcgucgccgacuacagcgugcucuacaacuccaccagcuucuccaccuucaagugcuacggcgugagcccgaccaagcugaacgaccugugcuucacgaacgucuacgccgacuccuucguggugaagggggacgagguccgccagaucgcgcccggccagaccggggugaucgccgacuacaacuacaagcuccccgacgacuucaccggcugcgugaucgccuggaacagcgucaagcaggacgcccugaccggcgggaacuaccuguaccgccucuuccggaaguccaagcugaagcccuucgagcgggacaucagcacggagaucuaccaggccggcuccaccccgugcaacggccagguggggcugaacugcuacuacccccucgagcgcuacggguuccaccccaccaccggcgugaacuaccagcccuuccgggucguggugcugagcuucgagcugcucaacggcccggcgaccgucugcgggcccaagcuguccacgacccuggugaaggacaagugcgugaacuucaacuucaacggccugaccgggaccggcguccucacgaccagcaagaagcaguuccugcccuuccagcaguucgggcgcgacaucuccgacaccaccgacgccgugcgcgacccccagacgcuggagauccucgacaucaccccgugcagcuucggcggcguguccgucaucacccccgggaccaacacgagcaaccagguggccgugcuguaccaggacgucaacugcaccgaggugcccauggccauccacgccgagcagcugaccccggcguggcggguguacagcgccggcgccaacgucuuccagacccgcgccgggugccucgugggcgccgagcacgugaacaacuccuacgagugcgacauccccgucggcgcggggaucugcgccagcuaccacuccaugagcucccugcggagcgugaaccagcgcuccaucaucgccuacacgaugagccugggcgccgagaacuccguggcguacagcaacaacuccaucgccauccccaccaacuucaccaucagcgucaccacggagauccuccccguguccaugaccaagaccagcguggacugcaccauguacaucugcggggacuccaucgagugcagcaaccugcugcuccaguacggcuccuucugcacgcagcugaaccgggcccugaccgggaucgccgucgagcaggacaagaacacccaggagguguucgcccaggugaagcagaucuacaagaccccgcccaucaaggacuucggcggcuucaacuucagccagauccuccccgaccccagcaagccguccaagcgcagcuucaucgaggaccugcuguucaacaaggucacgcucgcggacgccggguucaucaagcaguacggcgacugccugggggacaucgccgcccgggaccugaucugcgcccagaaguucaacggccucaccgugcugccgccccugcucaccgacgagaugaucgcgcaguacaccuccgcccugcuggccgggacgaucaccagcggcuggaccuucggcgccggggccgcgcuccagauccccuucgccaugcagauggccuaccgcuucaacggcaucggggugacccagaacguccuguacgagaaccagaagcugaucgccaaccaguucaacuccgcgaucggcaagauccaggacagccucuccagcacggccuccgcccuggggaagcugcaggacguggugaaccagaacgcccaggcccucaacacccuggucaagcagcugagcuccaacuucggcgcgaucagcuccgugcucaacgacauccugagccggcuggacaagguggaggccgagguccagaucgaccgccucaucaccggccggcugcagucccugcagaccuacgugacccagcagcucauccgcgccgccgagauccgggccagcgcgaaccuggccgccacgaagauguccgagugcgugcuggggcagagcaagcgcgucgacuucugcggcaagggguaccaccucauguccuucccccagagcgcgccccacggcguggucuuccugcacgugaccuacgugcccgcccaggagaagaacuucaccaccgcccccgccaucugccacgaggggaaggcccacuucccgcgggagggcgucuucgugagcaacggcacgcacugguucaucacccagcgcaacuucuacgagccccagaucaucaccaccgacaacacguucguguccgggagcugcgacgucgugaucggcaucgugaacaacaccgucuacgacccccugcagcccgagcucgacuccuucaaggaggagcuggacaaguacuucaagaaccacaccagcccggacguggaccugggggacaucuccggcaucaacgccagcguggucaacauccagaaggagaucgaccggcucaacgagguggcgaagaaccugaacgagucccugaucgaccuccaggagcugggcaaguacgagcaguacaucaaguggcccugguacaucuggcugggguucaucgccggccucaucgccaucaucauggugaccaucaugcugugcugcaugacgagcugcugcuccugccugaaggggugcugcagcugcggcuccugcugcaaguucgacgaggacgacagcgagcccguccucaagggggugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12338 - RNA, 4094 nt, Artificial Sequence; identical to SEQ ID NO: 149
  SARS-CoV-2/Wuhan/WIV05/2019__EPI_ISL_402128 spike protein mRNA gc (1-1273)(K986P_V987P) R9487, R9491, R9709, R10159, R10160

SEQ ID NO: 12339 - RNA, 4094 nt, Artificial Sequence
  SARS-CoV-2/Wuhan/WIV05/2019__EPI_ISL_402128 spike protein mRNA gc (1-1273)(K986P_V987P_T887WN_A1020W)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12340 - RNA, 4094 nt, Artificial Sequence
  SARS-CoV-2/Wuhan/WIV05/2019__EPI_ISL_402128 spike protein mRNA gc (1-1273)(K986P_V987P_P1069F)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12341 - RNA, 4094 nt, Artificial Sequence
  SARS-CoV-2/Wuhan/WIV05/2019__EPI_ISL_402128 spike protein mRNA gc (1-1273)(K986P_V987P_ H1048Q_H1064N_ H1083N_H1101N)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12342 - RNA, 4094 nt, Artificial Sequence
  SARS-CoV-2/Wuhan/WIV05/2019__EPI_ISL_402128 spike protein mRNA gc (1-1273)(I712C_T1077C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12343 - RNA, 4094 nt, Artificial Sequence
  SARS-CoV-2/Wuhan/WIV05/2019__EPI_ISL_402128 spike protein mRNA gc (1-1273)(I714C_Y1110C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12344 - RNA, 4094 nt, Artificial Sequence
  SARS-CoV-2/Wuhan/WIV05/2019__EPI_ISL_402128 spike protein mRNA gc (1-1273)(P715C_P1069C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12345 - RNA, 4094 nt, Artificial Sequence
  SARS-CoV-2/Wuhan/WIV05/2019__EPI_ISL_402128 spike protein mRNA gc (1-1273)(G889C_L1034C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12346 - RNA, 4094 nt, Artificial Sequence
  SARS-CoV-2/Wuhan/WIV05/2019__EPI_ISL_402128 spike protein mRNA gc (1-1273)(I909C_Y1047C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12347 - RNA, 4094 nt, Artificial Sequence
  SARS-CoV-2/Wuhan/WIV05/2019__EPI_ISL_402128 spike protein mRNA gc (1-1273)(Q965C_S1003C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12348 - RNA, 4094 nt, Artificial Sequence
  SARS-CoV-2/Wuhan/WIV05/2019__EPI_ISL_402128 spike protein mRNA gc (1-1273)(F970C_G999C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12349 - RNA, 4094 nt, Artificial Sequence
  SARS-CoV-2/Wuhan/WIV05/2019__EPI_ISL_402128 spike protein mRNA gc (1-1273)(A972C_R995C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12350 - RNA, 4094 nt, Artificial Sequence
  SARS-CoV-2/Wuhan/WIV05/2019__EPI_ISL_402128 spike protein mRNA gc (1-1273)(A890C_V1040C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12351 - RNA, 4094 nt, Artificial Sequence
  SARS-CoV-2/Wuhan/WIV05/2019__EPI_ISL_402128 spike protein mRNA gc (1-1273)(T874C_S1055C)
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12352 - RNA, 2318 nt, Artificial Sequence; identical to SEQ ID NO: 152
  SARS-CoV-2/Wuhan/WIV05/2019__EPI_ISL_402128 spike protein mRNA gc (1-681) R9489, R9493

SEQ ID NO: 12353 - RNA, 4388 nt, Artificial Sequence
  SARS-CoV-2/Wuhan/WIV05/2019__EPI_ISL_402128 spike protein mRNA gc (1-1211) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12354 - RNA, 4388 nt, Artificial Sequence
  SARS-CoV-2/Wuhan/WIV05/2019__EPI_ISL_402128 spike protein mRNA gc (1-1211)(K986P_V987P) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12355 - RNA, 4388 nt, Artificial Sequence
  SARS-CoV-2/Wuhan/WIV05/2019__EPI_ISL_402128 spike protein mRNA gc (1-1211)(K986P_V987P_T887WN_A1020W) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12356 - RNA, 4388 nt, Artificial Sequence
  SARS-CoV-2/Wuhan/WIV05/2019__EPI_ISL_402128 spike protein mRNA gc (1-1211)(K986P_V987P_P1069F) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12357 - RNA, 4388 nt, Artificial Sequence
  SARS-CoV-2/Wuhan/WIV05/2019__EPI_ISL_402128 spike protein mRNA gc (1-1211)(K986P_V987P_ H1048Q_H1064N_ H1083N_H1101N) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12358 - RNA, 4388 nt, Artificial Sequence
  SARS-CoV-2/Wuhan/WIV05/2019__EPI_ISL_402128 spike protein mRNA gc (1-1211)(I712C_T1077C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12359 - RNA, 4388 nt, Artificial Sequence
  SARS-CoV-2/Wuhan/WIV05/2019__EPI_ISL_402128 spike protein mRNA gc (1-1211)(I714C_Y1110C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12360 - RNA, 4388 nt, Artificial Sequence
  SARS-CoV-2/Wuhan/WIV05/2019__EPI_ISL_402128 spike protein mRNA gc (1-1211)(P715C_P1069C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12361 - RNA, 4388 nt, Artificial Sequence
  SARS-CoV-2/Wuhan/WIV05/2019__EPI_ISL_402128 spike protein mRNA gc (1-1211)(G889C_L1034C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12362 - RNA, 4388 nt, Artificial Sequence
  SARS-CoV-2/Wuhan/WIV05/2019__EPI_ISL_402128 spike protein mRNA gc (1-1211)(I909C_Y1047C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12363 - RNA, 4388 nt, Artificial Sequence
  SARS-CoV-2/Wuhan/WIV05/2019__EPI_ISL_402128 spike protein mRNA gc (1-1211)(Q965C_S1003C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12364 - RNA, 4388 nt, Artificial Sequence
  SARS-CoV-2/Wuhan/WIV05/2019__EPI_ISL_402128 spike protein mRNA gc (1-1211)(F970C_G999C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12365 - RNA, 4388 nt, Artificial Sequence
  SARS-CoV-2/Wuhan/WIV05/2019__EPI_ISL_402128 spike protein mRNA gc (1-1211)(A972C_R995C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12366 - RNA, 4388 nt, Artificial Sequence
  SARS-CoV-2/Wuhan/WIV05/2019__EPI_ISL_402128 spike protein mRNA gc (1-1211)(A890C_V1040C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12367 - RNA, 4388 nt, Artificial Sequence
  SARS-CoV-2/Wuhan/WIV05/2019__EPI_ISL_402128 spike protein mRNA gc (1-1211)(T874C_S1055C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12368 - RNA, 4412 nt, Artificial Sequence
  SARS-CoV-2/Wuhan/WIV05/2019__EPI_ISL_402128 spike protein mRNA gc (1-1211) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12369 - RNA, 4412 nt, Artificial Sequence
  SARS-CoV-2/Wuhan/WIV05/2019__EPI_ISL_402128 spike protein mRNA gc (1-1211)(K986P_V987P) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12370 - RNA, 4412 nt, Artificial Sequence
  SARS-CoV-2/Wuhan/WIV05/2019__EPI_ISL_402128 spike protein mRNA gc (1-1211)(K986P_V987P_T887WN_A1020W) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12371 - RNA, 4412 nt, Artificial Sequence
  SARS-CoV-2/Wuhan/WIV05/2019__EPI_ISL_402128 spike protein mRNA gc (1-1211)(K986P_V987P_P1069F) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12372 - RNA, 4412 nt, Artificial Sequence
  SARS-CoV-2/Wuhan/WIV05/2019__EPI_ISL_402128 spike protein mRNA gc (1-1211)(K986P_V987P_ H1048Q_H1064N_ H1083N_H1101N) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12373 - RNA, 4412 nt, Artificial Sequence
  SARS-CoV-2/Wuhan/WIV05/2019__EPI_ISL_402128 spike protein mRNA gc (1-1211)(I712C_T1077C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12374 - RNA, 4412 nt, Artificial Sequence
  SARS-CoV-2/Wuhan/WIV05/2019__EPI_ISL_402128 spike protein mRNA gc (1-1211)(I714C_Y1110C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12375 - RNA, 4412 nt, Artificial Sequence
  SARS-CoV-2/Wuhan/WIV05/2019__EPI_ISL_402128 spike protein mRNA gc (1-1211)(P715C_P1069C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12376 - RNA, 4412 nt, Artificial Sequence
  SARS-CoV-2/Wuhan/WIV05/2019__EPI_ISL_402128 spike protein mRNA gc (1-1211)(G889C_L1034C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12377 - RNA, 4412 nt, Artificial Sequence
  SARS-CoV-2/Wuhan/WIV05/2019__EPI_ISL_402128 spike protein mRNA gc (1-1211)(I909C_Y1047C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12378 - RNA, 4412 nt, Artificial Sequence
  SARS-CoV-2/Wuhan/WIV05/2019__EPI_ISL_402128 spike protein mRNA gc (1-1211)(Q965C_S1003C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12379 - RNA, 4412 nt, Artificial Sequence
  SARS-CoV-2/Wuhan/WIV05/2019__EPI_ISL_402128 spike protein mRNA gc (1-1211)(F970C_G999C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12380 - RNA, 4412 nt, Artificial Sequence
  SARS-CoV-2/Wuhan/WIV05/2019__EPI_ISL_402128 spike protein mRNA gc (1-1211)(A972C_R995C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12381 - RNA, 4412 nt, Artificial Sequence
  SARS-CoV-2/Wuhan/WIV05/2019__EPI_ISL_402128 spike protein mRNA gc (1-1211)(A890C_V1040C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12382 - RNA, 4412 nt, Artificial Sequence
  SARS-CoV-2/Wuhan/WIV05/2019__EPI_ISL_402128 spike protein mRNA gc (1-1211)(T874C_S1055C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12383 - RNA, 3998 nt, Artificial Sequence
  SARS-CoV-2/Wuhan/WIV05/2019__EPI_ISL_402128 spike protein mRNA gc (1-1211) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12384 - RNA, 3998 nt, Artificial Sequence
  SARS-CoV-2/Wuhan/WIV05/2019__EPI_ISL_402128 spike protein mRNA gc (1-1211)(K986P_V987P) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12385 - RNA, 3998 nt, Artificial Sequence
  SARS-CoV-2/Wuhan/WIV05/2019__EPI_ISL_402128 spike protein mRNA gc (1-1211)(K986P_V987P_T887WN_A1020W) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12386 - RNA, 3998 nt, Artificial Sequence
  SARS-CoV-2/Wuhan/WIV05/2019__EPI_ISL_402128 spike protein mRNA gc (1-1211)(K986P_V987P_P1069F) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12387 - RNA, 3998 nt, Artificial Sequence
  SARS-CoV-2/Wuhan/WIV05/2019__EPI_ISL_402128 spike protein mRNA gc (1-1211)(K986P_V987P_ H1048Q_H1064N_ H1083N_H1101N) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12388 - RNA, 3998 nt, Artificial Sequence
  SARS-CoV-2/Wuhan/WIV05/2019__EPI_ISL_402128 spike protein mRNA gc (1-1211)(I712C_T1077C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12389 - RNA, 3998 nt, Artificial Sequence
  SARS-CoV-2/Wuhan/WIV05/2019__EPI_ISL_402128 spike protein mRNA gc (1-1211)(I714C_Y1110C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12390 - RNA, 3998 nt, Artificial Sequence
  SARS-CoV-2/Wuhan/WIV05/2019__EPI_ISL_402128 spike protein mRNA gc (1-1211)(P715C_P1069C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12391 - RNA, 3998 nt, Artificial Sequence
  SARS-CoV-2/Wuhan/WIV05/2019__EPI_ISL_402128 spike protein mRNA gc (1-1211)(G889C_L1034C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
